United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 63

SEQ ID NO: 1003 - DNA, 581896 bp, Homo sapiens
cgcagcgcgcaccgagccggccgcgccgcgcccgccgctctcgccgctttcgccgcggtctcctcctctagcgcccgccgcggccggtaaatctcggctggaggagcagcggcggcccccgagtcaactttcattccctttttgcttctgcctcaccattctcttctcctcctcgaaagatggctgtttggagaagggggagaagttaagaggtcgccagcgcggagcgaaggagggcgcgatagcctcagcaggagcgggcggaggtgagtggcaccacggcagagtccccggctggtgcttgaggaaagccctgggaattgggggccaccggtcctcaggatgcgccgcggtattcccttctcgggttccgcaggttaacagcatctcagtccggactctgatgccacttgccttgcatctcgcagcccggagaccggtgggtttaagggaaccttcgtcagaagttgggtgctaggtcatctttgtggcatgcagaccctgacatttggctaggcaaactgaggcgagcggtcggtggcgtgattctctcccgcccccaaacacacccagtttatgttggagccgagctatgaatgaaaagtttgtactggcaacgtgttgcttgaggggagcaacgcttattggggggtacctttgatgtttcgtggaggacttcagttttaagtcaatacatcagaatcctgggttttaagaaaagttcaggaggctgggggatgggatgggagataaagcagttccttgactagtggaaggagagtgatgaatcgtaagcttattaaggtaaactggttaattagatgccatacgagggtgtcacagtggggactagagggaacggaggacgggggcgttccctgagcgcctagcaggctgcgtttgtttggctttgaagccgttatccccttgtccgcaatgagaggtgctggtgtcaggcctgtgtgtctgtgatgtgacagagcgggactgagctctctccagatccgaggcgcggttgtcaggagaggtggcctgcaacggagagctgaggatgcagttcctgtgatgtggacttggagaattctctagtgagtctcctgtgctccaatttcaggaagatctgtcaattgttttttcttccagggaggtgtgtgtaatctcctaaaaggaactttcagctttaagtaactgtagcattttgaaatcctataagaaatgagatatctacatatattcattatttcatgtatgtggggtgtgtatgtgtgtgtgtaaaatatgggaaaggggtaagaaaggcttaaaaagtttaacttctaccagaaaagaaagcgaagagttaatttttttctccccaaatggtataacaatgcatatacaactaaatactcttgctgtgctgagatttctcataaggagtaagatttaggaattacaagtattcagagcactgtcatgttttcaaatcttgcaggcactgtcgaaatctggaaaaagggagtacgtacatagaaaacccatattaaaggaaaaaaacattgaaaatctcccaaaagaaaaccttatgacatttgaaaaggcctggatgttttctgatgccccagaaatctttctaatcctgtaattaaaaacagcacagaataagttgcatttaagaaatcagcaatcatgtttaaaagatatcttttgaccttctttttcgtacttttgatttttattatggaaattattgtgactgaaaatttgttgtttaatatatttgccttttaccacagataattagtcttccttatccttttaaaccactgttccagtttggaccaatttaattccccaaacatcaaattactgatgttccttctggaaaccatttatgtttaaaatggctaataagaatattatatttccaaaacaacataatttagtcagttgtaaaacttgcttgtaatttattctcatccattttgtttgaatggggcacatttgaagaagagcagcattttcttagaatatgccattttctgtgtgggaaaaagctagtgttttcatatatgttttagctattaaacagatgcatgtaaggtggcaatcctgtctgacctttgataaactgccagccagagggagagagatgctttcttagctgtgctagtgaattgataatctttactacaaaatggacacggttagatgcacataaggttgtgcagaaggaagttaaggagttttaaattaaataccagtttatgggtaggagacagatttttttttttaaccttgatcttcctgtttctttctttctgcagttcagcctgttgggctggcctttattggagagtcagaccagcactctgactagagagtgtttagcacattaaagtgctgtcttttgtagaaataatgatggctcttttgcaattaaaaggtaattttatacatgcttatagatttttgtgattgtttggtgaccaaattaagcataaccgttattatggtagaaagagttgttttatgaagttattgccactatatataaataattatatatttaagatatagatgaattctatttgaggtttaggagttttgaatcttaaggccagctgaccagatataaacctatttaattaactaatttgaatgacaccagaattcagatttttattaatatctacatctaggtttatgtagctttcctttctttttattagaattacttcttttttgaatttgtttaaatattacaacatattacattataatttgtacacactcagtggggaaggtgcaggttattcttaaatagagatgtggagaaatagctaacaaggagagtcatttgagaaacatatggacatcataaaatccttctgtatgtagcatctgtaccttctcattagtgaaatattgtagttatggacattttttgttattacatccaaatgtggctttttatttttgcttcattggtttttttttgtttgttttaaaatacaatttgtattactgtttaagttggtgggggctcttactgcttgaagccttttgctttcaatagacatcatacttaatttttattgcatgcatctgcagatatatacaattgtttcccagtttgttattataattcttacactttttggtgattcctcaaaacatttgagagataagtagggtgacatattgttctcattttaggaaggaggcggcaggtacactgatatacccaacgttacaccatagtgaatcagtgtgaagctgagcttaacatctatatttcctgtattttaattatgagagcaagctgctcctgtgtcttatgataacttcataaatttatgtatttctagatttttaaagtggtcatctttatacatgtgcagatcagattttaaatcagtcaatatagtcataaggggatggatcatactgttggcctgttgatgggagagaaccatgactctaatagctactgctgaaataaacaaagaagcacacacacctctgcagaatatttgttcttgcaatcaatccatagtccacatatttctctgccctgctggcctcaccctatcaactacctactgcccttttactgatcaaagcagttcttaaagtttatcagcacagttgtcaagcttgaggatcatcagcctcactggcaagaaaagtcagaacctgatttttgggaagagagagtattgacgggggacagtaatggagtgttcactccagaggcagccagtagtggtcagagatcatattctgggtgtcgggatgtctatttctctcatcagctctgcttctttggccgaacttacaggtatcaaagtgaacagaaggtttatggaattatctagtcatttctttccatgtagatctcatatctgaataaatcagactttttttaaaaaaaagaaaaggacagaaacttgttctttttcttcatctcaccaaatctcctctccttcaaatcccactagaatttttttaggataattgcccacatgatttgtaacactaaagtgatagacttctgatattgcattattacacttaacagtggaatatattatccagcttgcagaaggaagcattgtaattctgtagataatggtaatatgtaatcttatgcaagtatttttgaataagcagacagtaccaagagctctccattaagctaatatgtatattcttactcttccattccctaaattacaaatggtttataggagctcatccaaatcattaagtatcaagtactgaaaaaaagttcagatgtggtttcctgtttactatggtgaattttgtttagagcttcaaagagaggaaaactactatctattgtttgctgcaccagagagagtataacgtgtttctggtgagcttgaggagcattgaggttgctggaaatggtactttcttcacatctctacagaagctgtgataagaaggagatgggtgtggactggtttagttctagtacagtagtgatgactggaatttgaagtgaccactgaaagggtaagatttggatagtctgtgtgtcactcaaggtattcagtagcaagtcatggaaactaacttagttaatataagcatcaaataaatttattagaggatattgactttgttttctcttgctgtgtaacacatttccacaaatttagcagcttaacacaacacccctttatcatatcagtttcattgctcagaagtccacacatagctcaactaggtcctctggccagagatcttctcccatgttggctagggctgcaatcccaacagaagatcaataggaaaagatccactttcaagctcttttctattattggcagaatttatctcatagtggctgtaggactgaggcctccattttcttgctggctgtcattcagaggctgcccttaactcttagaggctgctgttattctttgccatgtggccctctcataggtactgttacaacatggcatcttacttttttaaagctagcaaggaagtctctcttgctccagtctgataagaaagagtcttatatactataatataatagtgagagagtgacatcaggctatacaagggcatgactccttggaggtcagcttagggtatgtccaccacattgactagctcatagaatctctggtgtagggtgggcacagtggcttatgccggtaatcccagcactttggcaggccaaggcagatgaactgcttgagtccaggagttcaagatcagcctgggcaacatggcgcgaccctgttgctacaaaaaaatgcagaaaaaattacctgaacgtgatggtgtgtgcctgaagtcccagctagttggcaggctgaggtgggaggatcacctgagtctgggaatttgaggctacagtaagccatgatcgtgccaccatgctccagcctgggcaacacagtaagaccctatttttctttctttctttttttttttttaaaaaaaagaacctctggtaaagtcagcagacctgactttgaagccactcaagtagaaacaaggctccaaatccctctgcagaatttgtcctgtgaggtactgctgctgtcgctgctggcatatagcttctacagttgaatgtgggctctatatcataaaagagaggattctccacatataataatggggtcccattgtccattgccaaaaagaatgacaggtgtccactgctgagggaaagaagaaaaaatgattgcttaatgaaatgtttgagtttttggccaggataggcatgatagccttctagggatgggattgaattggaaagtgactgaagtcatgatgacttcttggaagagaaaactcttccaggatttaggagaataatggtaatgagggtccatttatgagtggtagtgataagaaaggagtagaaaacctttgaaagatgaatcactacacatacattagtctgggtattgacttaattagtccctaaatatattccacgcatgaaagacttttaagggactgattccactaatccttgcagggaaccagcgctgtgacttggaggcctgcagtgtggtctaccctcattttatagaaaggagtagagctaaggaccattgtactatatttgtggcccagtgactatagggtgctatgtagtgggttggggactattgaacacaccctgtgctctaagcactttgccagacacattttatctattttgtatctcaaactctggcagtttagtttatatttccctagttctgcctcccttctcccctggcaggtgtgtggagactttgaaaggctaaatactttgccaagggtcgttcagctaggggtggcattaggatttgaatccaggtctgattccagagcctgaagtcttgtagtacacatcccatactcacaagcagtaagtgaagtttccagggggaaagcctgttactcacattgaagtggatgtcagtgctacaattgctgttgggttccatcattcagcttgagagaactggatactgcaagatgagggttaaagagaggagtgagagagtgtgctgtatcatgccttcttttattttctcagcaggaagtacatattataggtctctcttagatctaaaagtaagaatggggagtagaggctgtgcatttttatttctacttatcattttggttaaaatcaaaagcactgtgtctcctttctttcctatatgtagatttctactattaaattaaatcaggtaacattatgaattctcattgcctctttggccatagggttctttctatagctttttcagtagatgccactgttttgatcttgaaaagtctattgagacattcttcctttgttcttctattactcagtccctctttctactctgtggtgcctctgaaatctattcatagatattctacttttttcttctgttttatgtacttaaatatcttctttaaatggatctagttccattgatcagaatcattggcccagatccccttgctgctccactgtacccaggaagtcttatctattttctgttaattttactgagttttactctacatcccagcacagtatgaggaagcctttaagatttccctgggtatctgagcctaaatgtaaacatttaaaactgaatacctcaaggaagagtatgattggattgtgttagatcaggtgcacacctatggactactccactgtggccaggcaaagggagttttattattgctccatctgggttcaggtgtccacccttctagaatactactgttctcaaagaaggaaattgtgagccagccccagcttgactggggtcaacagtactaatctattctagagcacactgtagctcaggaagtctctaaataaacttaatttcttcatataggttttagatttcctaaactagattaggccagatttgactttaaaagcccaaacttcttagcatgacacaagttctttcacagcctggacccagcctatctttgttacctttacttttttttttttttttttaggtgcagggtcttgctctactcccaaggctggtgtgatcacagctcagtataaccttgagctcctaggctcaagtgatccttctgtgtcagcctcccaagtagctaggactcacaggctcatgccagcgtacctggctaattaaaaaaaattatttattgtttatttttaaacattttttgtggaaggggtcttgctgtattgcccagagtggtcttgtactcctggcctcaagctatcctcctgcttaggcctcccaaagcactaggattacaaatgtgagccaccgtgccaggcccttacatttttaactgttgcaactccctgcctttcatccagtaaatcattaaggatttcaatcctaaacttggagctagcaagtggcttcgattttagataaacaggaatagccagcctgagagaatacatcgacgtgtaaagaaaagtcaagatgagagagagagaaataagtacatttcagtttttcacttcctgcatccagtcattcttaagtctcgttctatagctgattttttccacggatatgttatgtgagcaatgaattatccataaattgagtttctgcctcttgcaatggaaagagaaccgtgtagcataggtttctataagtgatcatctcgtagcgaaaatcagactttcattctgctggggttctgttgggggattaggaagctgtgcttctctgccctactttttcactgggcccagtgtatgtcccacctcttctgtgatgcttcccctgattactacaacacactgagatctcattcctctctgaattcctactgtagtttagggttatggctatgttttcgcaggcttacaaatggaattctagtattaattgagaaaatccataataaaaaggctactgtattaggaaagtctttaaaaggaatttgcatttttattaccccaaacagcatccttatatttttgaaatatagtagtatatttaatatacaggaggatttacatgtgtatttatggtcttcttgcaattaccctgtggctcgctagagattcatagtctcccaccacttagatggaaaagagggcagagaaggtttggcttcctaatgggtaccttctccaaataaaacaccacaggaagaatgggccggttttgactaagactacaggtctgtacagtatgagtgtgtttattttttattaaacattctacttaggtatataggaacataaatatgaatgcttttgcttatagatttcataaattataaaaccaaacccaacaaacaaatgttgaatataaacaacagaattgatgaaattaaaagaaacaacattgaactctgtgacaaatgatgctgtattgttgaaattacattgccagtatccagtttaaaagtataaagatgcagtctcagattctgtttttctttaatctatttctatgttttatatcaatatagatacaaaaattgtccttttacaaccaaacaaacaatgttaactttgaggctttgtgtatggctcaggataatcaggctttacacatgatcaaaattcctcaaataatccctcaaatgtcaggtttaatgaggtatcacctgagatctctataacatcttttcgttcccttgaaaatgtgattagtattgtggagtcatcgaattctaaatcaaatctgtaagctgtattccaagatttctggaatggagaacagattatgtagaagctacacagagataggatgcatgcattatcttcacactcatgatgattataacctctatagtacaggtacttttgcctgcctgtgctacccagtgttctgtaatgactcacttcatcctcaccttttctctaaacagactttatttgtttagcaacctttctattctttggtctccacttagtttatgcatgattcaaaacaccaagtgcaaacaacatgatgaaaatttggtggcagtatttagtttttaaacgtttattcagaaactgattagcatacaacatgtatatttagatgatcatcccaatgaaatcccaaaatggaaaaaaaaatatttcacatcaagctcatggacctcagtttgaaatacacagttgcaaatgttaattggccacttaaaacattttacatcttgccttatgttgtgtgtcattaatgaaattgtaagctccttgaggtgagactatatgcttactgttttgttttcttccatagcactgtgtgcatttgttatagttggtgaccaaaaagtgtttgctgattgaccgattattaatatattgttatttcctattgctctgtgactcaaaggcagggactattttgttttaatctgtggtctctgaatgcgtagcacagcaactctcacatgagaagtgcctaataaatgttctgaatgaaagaatggatgacttgttggctttgtgtgtgtgtgtgtgtgtgtgtgtgtgtgtgtgtgtgtattcgtactcttttagatctaatctcttatgtacagggcacttctaacagttgtatagattagtgctgtccagtaagattttctgtgatgatggaaatattctatgtctatgctctgcaacatcatagccactaggcacatgtggtctttgaaatttagcaaatgtggccaatggcctgaattgagttttatttagttttaatgagtgcatagtcacacatggctagtgggcagcacagacccaaatgataaaatgtactttctcaaacttatttgctctcatatctaacattattatattttttggttataattggatgttgttatttgattttgttgtattggatggatgaagtgagtttatcactttaaaaatagggcaatatagtccaccaagttgacttcattctttcctaaatgaccagcaacattggatgtcatctgttcacttgccccaccatctattttggtatttcatcatttccttattaggctagaggcctgacaccgctttaccaaataagttttatgtacacttttacctttttttttttttttaatgacccaggttatcttgcgtttgcttgtctttctgttttagtccttttttcccctaataaaccatttaaacttggattatctatatcattattatcatttttagagacaaggtcttgctctgtcacacaggctataatgcagcagtgtgatcatagctcactgcagccttgaactcctgggctcagctgatcctcctgcctcagcttcccaaggagctgggactacaggcatataccaccacacctggctaattttttattagattttttcttttttagagatggaatcttgctttgttgaccaggctggtcttgaacttctggcctcaagtgatcctctggagtaactgagattataggagtggaccactgcacccagcctatattatcattgttaataccaccatcatcattttcatttctggtgtttatgctttgccagcccatatttgatgttgtgtactaacgtctactgatagtctaaacacatttcaaatttattataatctgaaaaatgtctgaatattctttttctccaattgttttctttgcttatcttgcccttttaccctttctggtccagaagaatgaactagcaccatatgcatttaaacattacaactcagtccttacataagatgtaatcccatcatgacaagtttcactgctgttgccaaatccgtgaaatcgatactacaggactgtcatttagaaagacaggaattgcttcctgcaaatggctgagatctttatgcaatttgtagttctgctggagcaagacttctaagttattgtacatatattgaacctcagtattgggtatattcaattctcctttaattcttataacagtattgaatctagtagtatgtaatggttatagaggctatctatgcaaataagttgaaatcagctctgctgactagcagaaatactttagaattttccactcattttctgtttactgctagagatttaattgttgtcttatgtggcagaatttgaatgcacagacttcagcatggaagcttgccttttgttcatttttttagtctagcttagtagttcccaaacttgagtgtgcatcagcatttctgttcagggcgatacacacaaaagattgttaactatactttatggatgagttaacctcttttcaaggcagttttgtctatactagattttcatcttggaacctacctttccctcattaccccaaagatgcatctcctctttattccttctatttctactttcagtccagcacacagctgctcattgagtggacttgtagatgtgctcttgaatagatttcacacaatgggagacaaattcagtagcaatatatagaattttgaacttgtgaatccccggttgagcttttatcttcttattgctttcatatgcctctctatggtgagaagctagtactgctttgttatcttctttcccaatttttccccataaacattctcctaaaaagccctaatgatgtaaatgatacattatgttcattcttgacaggttggggaaatgaggaagggaactttcctttgtgacttgtgctgtagatatattttaaaatctcctatttatctatttgacccaatttttaaaagttacctacattaaaataaatattaaataaatttagtattataatgaaacagtagtttgcttttatttataaagttcatctgggtgtgttggctcacgcctgtaatcccagcactttgggaggccgaggcaggtgtgtcacctgaggttgagagttcgacaccaacctggccaacatggtgaaatcctgtttctactaaaaatacaaaaaagaaaaaattagctgggtgcggtggtgggcacctgtaatcccagctacttgggaggctgaggcaggagaatcgtttggaccctggaggtggaggttgcagtgaactgagattgcatcactgcactccagcctgggcgacagagtgagactctgtctcaaaaaaataaagaaaaaaaaaataaagttcatcaaaggcctttgcttaaacttatgagataacttgtttactaaccagaacacccttttggagttacttactgcttttctctgtgagaacaaacatcatatattcaccttaacttatattttcaaaagtataatgctaagactactcaagccaagtgggaaagtgtaggccaaatggaatagtatttcagaataacggctacagttttaatttctctagaatagcagatctgaaatattgttgtgtgttctaattttcaggtaactactggaaactcattaaaatatattttataccctattctatttttcttacatatgttataaagcccttactacattcgtattttattaaaacagtaattatttaaagatatttatgtaaaacagaaatcttttgtatttactcgagtagttaccatttcagtgctctttattcctttgtctatatccagattttcctctgatatcctcttccttctgcctgacttcctttaaacattccttgtggcacagatctgctggtgatgaatcctatcagcttgcttttgtatttctgaaaatgtcttatttcaccttatttttgttggatatagaattctaggtcagtttttttcttttaatagtttaaagatgttacttcactgttttatcatttgcatttttttttacaagaaacctgctgtcattcttacttttgttctcctttatagatatcaagtcctataacgtattctgtttattcctggttttgaacaatttgattttaatgtatcttggtatagctttcttcatgtttcttgtgctttgggttcattgagcttcttgggcctgagggttaatagtttccatcaaatttgaaaaaaaagttagtcattatttcttcagaatttttttaggagtccctcctcttttttctcttattcaggaactccagttgcatgtatattaggatcactgatgctctgtttgtttatttttattttttcttctccatatgttacattttgagtagtttctattgctgtgtcttcaagttcattaccaagtagtcatatttagtgtgttctccatctcacacattgtagttttcatctcttgaagttcaatggggtgtttcacaattttccatgtccctatttaactttctggacatatggaatagattcataataactgttttaatgaccttgtttgcaaattctaatgtcttttttagttcttggtcaattttgtttgatagactttttatccttgctattggttatattttcctatatctttgcatgcctagtaatttttgatggatgccagacatcgtgaattgtagggtgctggatatttttatattcctataaatcttcttgagtattttttttctgggatgcaattagttactgggaaacagcttgatcctttcaggtcttgtttttaagattagtttctgagtactctacccaacaccccatgaattatgaagttttccagtctggctggtaggaataggcacaattcccagacttgtgtgagtgctgggtactgttcccattaacactttcaggtggttcttttcctaactttgggttgttttctcacatctgtgtcctgatcattacactgctgaatattcaaggggggagctcatttgtagacctctgaatatctcttcatatttagctttcccccctccagtactctggcctgtgacatccagctgctctgatctccttagttcctccaattcatctcctcaattcagggattattctaggctctgcctgggttttcctttcctgggccacaatctggaagctggactagtcatagagcccaggtcatcagtttcccatttcttagggttcacctcgtgtgttttctgtttgtcaaggattattgcattgtgtccagtgtcttgaaaactattgcttcatattttgtacagaacttttattttcttaggcagggggataattccaatccctcttactcagtcttctttggaagtggttcccccattccttttctcttccatgtaaaaccttgttggtcaatatcattttggcgactacttaagtatttaatgctcaatttaatgtagtttattttgatattctacatctttcttttcagcagtttccaaattttctttaattaacattttatattacaagcatattttaaaaaatccattttgcacagttatattctatatcatgcttgatgcttttatcactgtcctagccattcaaaaccattcttaaggcaagctggtcataaaataaggagttaaatttgttgagcataataatttacatgcttttaagtggataaaagatgccactatgggaaagtaccatgttttttaaggatagaagccaagtggctttgaaataatgtactcttgaatctagtaaatgtgaatgatcataaaacagctcataaattactatattttaaattggatcacttatggattgctcctcttttatatttattcaggaggttctgtagttcatggataggccttgagattgttcatatgtcaagcaatagtgaactatgtgctggtgaattattttatttttaatcctctctcatatttgaatgataaaatatactactgtgaactaatatgagaataaagtgtcaaaattcaggagcacatcttgctatagtgaatacatcttgttacttcaagagttttctggcagtaagggcacaattgactgtgataatttaaaagaatccttgaggtggtatagttccatatgtcgtaggaatatgtcaatgattttttaattttgcaatttgagtttttaatgtagtcttttgaaagctagttgttaagcatggcaagaagactagagttactttagaattcttaggaaaataattttgtaagaacaaattaaaattaactttttcttcagcactgtcataaatatcagcaccatgaagccaaaattgtggcagtgttacatggctatgtttccaatatttaagaataaaggttaggccagatttatattctcttgcaaaattgaaccaaaatataaataatttatagaattttaagaatagaatcttgaaaaagcgaatactactctgtgagggagactgttagttgtctcctagtctctcttttccccactgtcctcagacataaagcacctaagttttagctggggacaaatccctacaggatagagatgacatttcttagccttccttgcagctaagaattttaaaccatgtgacaaagttctgaccacaggatataaacagaatggttatgtgcaacttccaagtaggccattaaaggacggggtgtgctgtctcctttcccttctcatttgctggaatgtgggaataatggttgcctatcttagactttgctaaggatgccagcactttaagaatggcagagcaacaagatttttaaagaaggcctaggacagtgtattaatctgttctcacactgctaataaagacatacccgagactgggtaatttataaaggaatgaggtttaagggactcacagttccacattgcgggggaggcctcacaatcatggtggaaggcaaaggagcaaaggcacatcttacatagtggcaggcaagagagcttgtgcaggggaactcctatttataaaaccatcagatctcatgagacttgttcactaccatgggaacagtatgggggaaaccaaccacatgattcaattatctccacctggctccatccttaacacatggggattattacaattcagggtgagatttggttggggacacagccaaaccatatcagactgtgatagtgacatttttactttattattttattttattttatattcgggggatacatatgcaagtttgttacaagggtatattgtgtgatgctgaggtttgggcatctgtcgatcccatcactcaaatagtgaacatagtacccaataggaggtttttcagccctttgcgccatctctctggctcctcccttttggagtccccggtgcctattgttcatagatgatgacttcttgaagcagagttgccataacagcttggagtcttgtctaactaagccactgttattttcagtctctgtcacgtacagccaaagctatatgcagtaagtcctcacttatcgttatggataggttcttggaatctgcgaccttaagtgaaatgacgtacaaggaaaccactgttaccacaggctaattgatataaacaagagttaagctcctatggcatatttctggtcacaaaaatatcaccaaacttctacataaagatcgaaatatttctaatataaaacatcggaataaatgtgagctatacatacataagaaagattcctaaaaacaagtctgaaaattgtttacccacttacaccaattcatggtcttgggtggccagagccgatcccagcagttcagggcaccagttgggaaccagccccggacaggatgccatcccatctcagggaacactcatacccacccacattcagaccgagactgtgtagacacgctgattcacctaacatgcacagctttgggatgtgggaggaaaccggagtacccagagaaaacccgtgcagacaaggggagcatgtgcaaactctatgcacacagtggcccgggctaggaagtcattttttcttttatcaactttataatgaaacaaatgaaatgacattatttgagaacctgctgtacattgttcccataattgtatttttttttttgtttataagacacattaagggtttctttttgtaaccataagcttgaaaggaccaagtgatcatacatcatagagatctaaactttttcaaaggccttcatttttttaaaaccagactatttcaatatctatcagctgaggtgaggaacacaatataattaaacttacctggctcttgtctgagaaatttaaaaaaagatttgaggcacttaaatccttatgctgacttttgaaaaaaacaagggttgggaaaagagagaatgctaagttgttcagctttctactttgcccgcagacaccaaatattttttcaattttcagttcccagtgtgaaaagactccctataccatttcacactgtttactactcccccttttggaaatgatcatcccagagcttctgggatatcatactctccagtttcctcctctgcctctgctctctccttgtctcctttttgggaccctatttaattcactccctcagtgtgggcatattctgattcttggctcacttttccctttactctgtaagggagatcacaaattggcagcttatagacatgttttgttgatgccacacagaattcaaagtaatttaaattttgaattaatcttttctaaaggctatttccttttcctccccctttgttttcaattccatttcctccttcagatcatttctactattatcttaatcagacaatcatgttgtcttacctggcttccttgcaatagaattctaaccaatattacttttggaatagcctttctaaaatgaaattttaatatttttctatctagcctcaaaactttgatcagctcatctgctttctagatgagatttcatctacatctagatgctttctagatggggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctaggatgctttctagatgtggatttcatctacatctagatgctttctagatgtagatttcaaactctggtgttggtatgaatgcaaaatgggcacagccacttcagaaaacaattttggtagttcctcaaaaagctaaccagagagttactatattagctaggtatacacccaaaagaattgaaaacatatttccagacaaaaatgtatatatgattattcatgtccatttataatagccagaaagtggaaacaacccaaatgtttaccacctggtgaatagataaacaaaatgtggtgtagttgcacaatggcatattactaggtaatcaaaaaggaatgaagcagtgatttatgctacacctgggtgaaccttgaaaacattatgctaagtgaaagaagccagacttacaaggccacatgctattttattcaatttataggaaatagccaaagactaaaggtagaatagtggttgcctgaggcaaagggaagggggaatgagatgtgactgctaaaggatatagggtttctttctgtggcaatgaaaattttctggaattagatggggctgatggctgtatacctctgtgaatataataaaaatcactgaattatatagattaaaagggtaaatttttaggtatgtgaatgatacctcagaaaaagtcagggaacgcagtgaaaaacaaaacaaaaaccgaaagctccttagaactcaagatccttcatgatctgacctttgctggttttcccagtctcatttctgggtactttgtctttccatatccattgcctgtctgttcctctctcccttgcactagtctgctaatctacaaactcttccaagagttccatgctgtctatgagtcttattatccatgcacacatttctttttttttttgagatggagtcccactctgtctcccaggctggagtgcagtggtgcgatcttagctcactgcaacctccgcctcccaggttcaagtgattctcctgcctcagcctcctgagtagctgagattacaggcacactctacgacacctggctaattttttatatttttggtaaagatggggtttcaccatgttagccaggctggtcttgaactcctaacctcaaatgatctgcctgctgcagcctcccagtgtgctgggattacaggcgtgagccaccgtggctggccctgtgtacacatttctaccagaaaagtccttcccactctcttctcctcacattcatctcttaaattcctgattttcttttgagttcatatttcacctctcctggaatccctttttatacaccagtgctggaatacttaatagggggattatgtagactcttcagggcaggcaggagtaccctacaaatgaaaataaattaactttgatgagcttataccacctttgcaatcagaaaatcttgaaagaagcttttttgagtgtgcatgtaagtgttatgtttcatagtttttaaactttaaataaaatgtagtggactgggtatgcaactatgatattttagaacaagcatcatgtcacaatattaatctggctttgctgccccctctcccctgccctgtgtagattaggagcaaacctagggtgtttgcgcttcccaaatactctgggcatcccttgctaccctaaatggtaaatatccgtttctttttctgtctctccatctagactgggagctgcttagtgataactgctttgtctttcattaaaaaaatctttacaactaaattccagtaattctccatagaaagtgtttggtaagttttgaacaaatgattagacatcctttgtggtcaaatgtaggcatgtgagagagactactagcatttgccctactgaagatcagagatctgaggacattttaagaaatgcctaattagatggcttcattgaaatacaacttgatctctttcttgctctctctctctctctctcacacgcacacacacacacagacagacacctcctttaaaaagctaattcaaaaagagtagaagcaaaaaagtgagatttaaaactttttctcaacctatacacctgaggaaggtgttagatttaaggcctaaagtggattttaaactgacacctcccctaacatatttttaaagtgttttctgtactttttaaaacagcttttctttttcatgtcagcaaattcatgagttaacattcatgtactaacattaactcccattttggacttgctcattatgcagtggtagatagtggctggttaatgttttctctttcaaaaatgtgattatacttagttatttataagtaattcccccttttttacctttcatttttaaaactagaaattcttgtttcgaccctatatgtcttatttgggttctctgaatcagattcttagacaaagatttgagtgcaggtagtttactaaggaggcattcagtaaactgtttgtattaagcaagttactgacttgagcaactgaaattttaattctttcgggggacctgtgaaaaatatgcctacaattagctacatgagaagcaagggagttgggatatgatatcctagaacctgttagtccttagttgagggctcttctagggggtgttaatacccagagtttccaactgcagtgcaggtccagagaaaaccctcaggtaaagaaataaaagggttgacggttggaagtctgtgggcacagattcaagtagcaatgaccagggagtgtggggcagtaccaacagcgttcactgtatatggagatgggcgccatcatgggaggagtgctcaagtgtgaaaaagcccagaatttaagttagtttttctcaagcatttactcagtcctcaggtaagtacctactgtgtgtaaaggctgtactaggtaatgggatgtatgaattcgcttgtagaggcaattagctgtttaaagctcagtttctttatttcaaatgagaacttattttctttctttcaaaatggagaatcaaatgagatcgtattcctgaacatactttaaaatgttgagagcattttacactcatctcctttttttttttttttttttttggatatggagtctcactcttgcccaggctggagtggcagtgttgtgattttggcacactgtaacctctgcctcctgcctcccagattcaagcgattctcctgcctcagcttcctgagtagctaggattacaggcgcgtgccaccacacccagctaatttttgtatttttagtagagacagagtttcaccatgttggtcaggttggtctcgaactcctgacctcatgatcctccctcctcggcctcccaaagtgttggattacaggtgtgagccactgcgcctggccacactcgtctcttatcaggaatatgttagccagtcaaaagcttgttttcttcttaggccatgtgaatttggcctctctgcgaaacatgtataagacagtaaatttaaaagtttcatgaaaggaataaggtaccatggggatggttatttttagccagttggcagtgaagacttcctggggaaagtggataaaatggaccttaaagtaatggataggaattatccatgtggaaacagggaatttctgaaggaacagtgaattccaggagagcttgagcaaagccctagaggcagtgcaactgagaaccactcagtacccaggttaagcattttttcccccttaactacaaattgaggatattagtactacctacactataagattgttgtaaggatatcttgtaaggataaatgagctatgtcatgtaaggtaggtaggttagggtaaattctaacttcatctgtagcttttggtgtcagtgtagtttctgatgataagttatccagtcccaaagaaagcagtgtttcctaaagtagatgggatgtaaaccccacaacatctgcaagaaaaaaggattatgacattaaaagaatttgagaaatcctgtgtaccatacatagatggatttcatagagaggcacattaagatattaacagtgctgagaagtgcagcaataaataaacctttttttttttactttgtttaatgctgtgtattaaatttctttaattgctggtttcttttctccccttaatgtaatacttattcatgttggacattctttgtaaaatgtgaatttgaagagcttcatgtggtgcgccaaccaagttaccagtacttacatatccactttaatgttgttaatctatcttaaggagttgtaaatggcttgaaataataagaaactttgcttaaaatactttttgtgattctccctctaggcatgcttctgagcagtttcttagtcattgcccccacatcaatcattgtatggtgctttacatatttcattcctcattttctgcacagaattgtattgctcaccccatgatttctcccaggcctcagatctgctcagaatgatgtttttttggcctcacttgagataatttaaagaacattccccagacaattctgaaagttgacttccaaaaatacttggagtaatgccatcatcattaaactaagtggatgactttcaaggtgagtggttttaaaagggacagcagcttcttggacgtgcactttctctgcagaacaaatggtttgtctttttatagtcatagaaggagctctgaattcctactatgtgtttgtccttttggtagatatagtctattttgggcagaagttcatagtctactggggtaaaaaataaatgttcaaaagtaaccactgtagaagaggatagatatagtcataaaagctacagagtgttatcaaagtacagaggaggggtcttccataggggtcaagaaaagtggcaaggatacttacgatgaaccttgaataccacatgaacaatagagatattccaggcagagagaagtaatgtgcagaggcccagagatgtgacaaaggacaaggaactccatgtaagtgcaaatggagtgtagactccacatgggaatatggatggtgagtgaggctgggaagccagatggagtcctgactataaagggctgtgtaagtgctggggtaaagagtttggagtttagcctctagatggtagagcacacctgatagattattagacagagatggccatagtcacaattttaagcaatttggtaagtggcaactatgcagttgagttggagtgaggaaagacgggggccaggagcttgggaggctattacagcggtccagccaacggggagtctaaactgaggtagtaattgtgatgatggggaagacaaaatggatatgatagatatttaaaagatgaggaacggagatgataaggggagtctgggattctttcacatggggaagagtttggatgttggtataggtcagtgtaattagaattcaggagagaaacacattttaagggacatttgctgagttgtattctgtatttgttgtgtttgaagtgcttatgggttattcatttgtattttcatcagttcctagagtaagtactctgtgccaaacaatgtgtttgactctgaggatgtggcaagaaaagagtcagaatgttccatgtgcctgtgaagcttacagcttagtgggagagacagacgtaaataattacccaactaattacttcattagtaagtatagaagaaggggacctaactcataaggaagtcttctgtccattctggaacttagcaaaatagtttggtctgcaaagtgacagagatttgaggatgattggtgagtagttgctaactgaagtcattagtgagattgcccagactaggtttgcaaaacaggcagaaaaggaggcctaggttagaatgtgaatatttaaggagaaagttagataaagtcctaaaatgaagctggaaaagagtggcagagtatcactgcccctcggtatctgtggtggattggttccagcgactcccttggataccaatatcagtggatgcccaagtctcttgggtaaaagggtatagtgtttgcatataatccatactgtatactttaaatcgtctctatattactaataatacctaattcagtataaatgctatgtaagtagttggtatactgtattgtttttcaacttgtatttttatattgttattgcttatttatttatttttaaaaaatattttgcatttgcaattgaatttggggatgtggaatccatagatacggagggccaattgtaatttaaaggtgtatggaaagggttgggaatgttgccaagaggtcacataaagtaaatgtaagaggtgccatgggctttgaaactgcagttccatgctggctctagcaagagcaggtgcagtagagtggtgtatgtacaagctgtatttcctgccagtggtgtgctagatctagcttatgctgccttgagagagctggattgttaaattttcaggaattatgcaagctggttgttaaaatagccattagtaaaaattaaagtatgtacacttacaattaaattgtattagaatagatgtagtaaaaatattaaagctcatcctccctaattattttacaacatttttctattatctatgctcttaaggttatttatgtctattattttcctgaatgggtggatgtactatacaatggtgtactaccgcacatttcttttcaagtctatgtttattgactcttgttggcatattgaaattagccaaagtgagagtatttacaccgtggaaattggcaaataaatgccacaaatcggagattttgttttgttgattttctagacctgagaaagtgatagagaaattgttaagaatgcggactacagttaaacttgtgttggtatacaacaattacattgtgaatggcacaaaaaaatcgaggaaatggtctttcggtacttgtgaactgtcatccaattcaataaagaagttgctctcaatattgatgagtaagagaagttccgatatacacagtcattgtttcactttcttcttacttattaatgcaaaagaaaatattattagtgtcagaacctaccaggtttggtaagtattaatgaaagcattttgtaagaaacagttggctatatggaattttcagtaaaggatattatatgttttattattatttgtcaattgtgtgctgtatctcctttattttagtacaatttataatgaacatatatatgtgtgtatatacacttttattttgatgagagccagttgttaacatttatcagcacacagtggctatatatatgggatgtgaagaagcaggtcacacgtacttttttgaaaagtatggcagagaagggatgttgcataggtactaggttggtaggtagtcagaagatgtttacaggtttgggagagcgtttgtttgtttgtgtttttccttgagtggaaagtgagcagccagtagagagggagagattgatggtacaggcgaaggtggaagtaaatgttagaagaaggcgataaagaaataggaagaaataagatatagactattgtgggaaaattaaccttgaacacaggaaggacccctattcctgtaaggatgaggaaatgataaacataagatgtgataaattaagtacacgtacattaaaatcacgtacatcagtgaattgtaatttaagaaataagaaggatgaggtcaggaaaagaagctcagaaagatatcagttaatttatgaataaagtatagattaagaggtgaatactatgattgaccatggcaagatttcatgctgatttaatctctgaactattatgctgtatttttagtctgtttttctaggctgaaatatttaaataaaaaatgagagacaatttgaaggcgcctcattgcatttaaatgccaactattatttcttttacttagctttgcaatgtaatgctacatttccatggacacggattaagtttctacgagatgatcagaaatgggatataatttgaggttgactaaactacattcattgcatgcatggatagtttgaacacaaggtaaaatgttatccagactgctgaagaaaacaagtcttattttggaacatgactttcttcagcattataatttatgactttttcacttggattcttgcttttaacacactcttatttgtatatgtatgcttcaattaaagaaatgcataacattttgcttacactgtcttagttctattagttttcctgtattaaaatttgcagtccttatatttctctcagttgaaacatagtaagatacagagcttttttttatatttgcatggtagtttgacatttcaaatcttttcagatctattttctgaaatattaattatcctaaatattcatagagattggtattgatgatgctaaatatggctgttgatattgaatatacatatgtaatctgcccttagtgtgccattgtagctatcactttgagcctaacactgtagttacattccccctcaccttgcagtctaacagcacctcagacatctggctgaggacctcaagactttggaaaaataactctgcatgtatgttttcagagttataacactgttgtagcccactcagacagctggtccttgtgtttgttgattaatttatggttgcaagatgatactgtggtctaaatatcatgttcaaggtagaaaaagagggaagaatcagcacagcactagccatgtgtgtgtctggtttaatcaaggaagcaaacgcattagagagacatccttagcggaattcttcttagacctcattggccacccttggctacaatagagtttgggaatgtgaatatttagctttcccacatctatattgggagacagcaaaggagaaattggtagagaatgactgttgttagccaattagtagtgtttgccaaaggggatgatctcaagtcctgtctagctccaacctttgcatttttactatcagttgaatgctatttcacctggaaggctacctttttagtccttacctgcaggcctgggacaaactttgttgacctccatctagactatttttaattaataagtgaagacctgacacaattccttctggcggagaggatccattcttcaatgtcaatctagatggagcagtccaggaagtaaccccagacttgaaagggaaccaatattaatgacatctcattctcaagcatggctgctgggaaggcttctgtaaaaaagataagcaaagaggaaagtgatctgagaatctgcctgataatactttttatatctgaacgatttaaacaaatatagctgcatacattgctgggtggttttccgttttgtgtgggactatatattcagacttcttgtttgaaatatgttagcctcttcgcagctaaaaaatattagaaacgagtgaaatttaaggcaaccatttgttcatacactcccagggagcatagagtatagattagaagtgtataagtatatttctaaaaaattcatatgtccgggcacagtggctcatgcctgtaatcccagcactttgagaggccaacgtgggaggatcacaaggtcaggagatcgagaccatcgtggctaacacggtgaaaccccatctctactaaaaatgcaaaaaaaattagctgggcttggtggcgggcgcctgtagtcccagctacttgggaggctgaggcaggagaatggcatgaacccgggaggcagagcttgcagtgagcagagattgtgccactgcactccagcctaggtgacagagcgagactctgtctcaaaaaaaaaaaaaaaatccatatatggatcaatcttgcagtattcacatttgcaaaaatataatacttctgatcttctaggcaagtgataattcttttagatttgtgagaatatttttagatgacaaaaaaattggttgcacaagtgcatgaaaagccaatgattatgttatttgcaaaattacattccaccatgaaaatacaatgagatataagtttttctgaaaatgtagtagattccagtattgggttaagtcatttacattttatattattttatatccttgagggagttactattattttctccttttgaggaatttgatgttcaaatcggttatttgaccagtgtttcagtgccagtaactcatagcagctatactgtgaaaccaggcagtttgccatacctgccagctgtggacctgtgctcctagtaataataacaattaggcattatgccaaagattttatagtcacttaatctattattcattaaaatcctagaagctgatactactatcatcatccctgttttaaagctgagaataaatagtattagagagattcagtagctgtctcaattttttgcagcttccagggctaacctgtggcttcaaactcaggtatctgacaccatgtggaccctaaccacttcactacattgatacttagttacacgttgaattgtatctctatagttttctataaaatgtagtgtttatttctatagagaaaaattcatccacgttttgaaattcaagaaaagccttctcatgtttctcaatggtttcatgctgagataattttcctgtgttagatcaaatttgctagcaattttcgtggtgtatgttaatgaaaatttgatatgcattgctttgtttcttgcatatataaccataatttagattagttcattttttaggtaattgaatttttgagaataagaaataaatttatattagaaaaattccagaatgagaaattggacacaaattctagcaattgtgaaaattatgcctgcttggaaaagttacattttatgttacttgctaaaattttttgaaaaggataaagtgatcaatttatctgtcaactatcactttgattaaatgatattaatcaaaagtactgtgtattcccttatactgtgaattatgattgggaaaaatgtgattgatattcagtgtttaaaaataacctacctctttatagaaacagctatatgaaattatagttcattctagatcaatagtgctttggttttggttaacatatgtatcacataaaatatatatgttttggttaacatacgtatcaaataacatatgtatcaaataaaataataaaaatttatttttttattaacaaataatagagttgatttaataaatcaactctattattctaggcagatttcatagcctaactccccttcaccaaattcagtgctgtatttcatagtgattgactcagaggagaaagatctgtgacttctatcttgctgcatgaccttggggaaaattggcttaaatgtatgaaaggatatttcaggcattgactcagactaaataaatgtgctaaatttgatacagtgagtgggaaatttttctcaccacatggaaccactaatgagcttgggaagtaaacatagttaagtaggcatagttgcctttttgttacaatcattctgaattggtccattagcctgaataacatttcaatgaacttcacatttgtagctttaggattgaccaaaccaaaccgcaacattataaactatttccaggtgagagggttgtagtgggttgaattgtttttccccaagaggtctgtttaaatctgaacccctggtaccagtgaatgcgaccttatttggaaaaaaggtctttgccgatgtaatgaagttaagatgagatcatactggagtagggtggcctatcaatccaatatgactggtatccttataaaaaagaagagaaggtcaggagatcgagaccttcctggctaacacggtgaaaccccatctctacaaaaaatacaaaaaattagccaggcgtggtggtgggcgcctgtagtcccagctactcgggaggctgaggcaggagaatcgcgtgaacctgggaggcggagcttgcagtgagccgagatcgcgccactgcactccagcctgggcaacagagcgagactctgtctcaaaaaataaaataaaaaattaaaaaaaaaaaaaagagaagagatagagagactgagatccccgcagggaaaacaccatgtgacatcagaggtggagactgggatgatgcagcattgaattgatgcattgggatgatgcacccactgaagaatgctaaggattgcctgccaccagcagaagctaggaagaggcaaggaaggactccatccagagtctgagagggagcgtggacctgctgacaccttgatttcagacttctggccttgagaactgtgagaaaataaacatctgtggttttaagctgcccagtctgtggtactttgttacggcagccctaggaaaggaattcagaagttgagaatggagagacaatggagagaatgaagagtcagcagcagtggtagtgctccctggattgactctttctcctgtagttccacatctttcctcctctcttatgttattatcatacacattagacaactgggctctgtttcctcccccttcatcacttacagatctctctgagtctcatttgccttgtcagtgtgatgaggatcttaaactcctctgagtaataataacaaccaacatttatgggagtttaaccccatagtaaagccagggctcagggttaacatgcattctttcatttactcctcaccagaatccatgaggattatattgttattatccctacttcacaaatgagccaagtaatcacatttctctatgacatcttgctttctcttgccttgttccttcagagacttgaacatgagagtcagaactggaatattgtcagtccttatggttccttgatgggaaatatagcagatccctaactttacttaatctgggtagaatgggggtgaaggccattggaaaggaatgttacatcaacatgttgtgtttgtcttggccatgtcacagtttcttcatgtatagaacatagaaattttttataaaaattctttcttcattatatttcccctattttattggggaaaataattttaatataactcccttattttctagcttgcttgacaatttcactgtctgagctacttaggatataacagaggaatttaatgatatagttgctattattgacattcaccatgtgctaggaacagcattatgtacagcagactatcagatgggtgatattattactccacaccctacagtccagggcttaagaaagtaacatggtccaaattactagccttcaaatccttgtctattttgtatccagagcctatttttgtatattctttttagggaaagccattactacagtgacatggattaatttatcagattaatgctgaacttggaagctggacatctgggctttaagagaatattggccaagaaagggtagtatgggaaatcggaaaacacctgaaaagtggcatgctgaatgcaggtagcttagatttaagacggcatgagtaccccatttttgtcagcatggggatatcagagttgaacctggcttctttcagaatattttatctgaagctcttctagagttagactaatttccttaattaccataattagggccaagcaaaaattggatgtttcctgtttcactttttggttgcttattttctctgagtcaagaacatgataacaaactttacactctatttctaacatggaccttttagtaaatggtaggttactataacagaaaagatgctatatctgaaatcaaagtgcaccagtccattgcatgctccatgctatttccttgcaagtctagatactgtcacatgcctgtaatactaaatagtcttagaaaatacagcaagcagcagtgttggaataggtcttagaggcaaaactgatctgaccaagcaatgtatgttggttaagtgaaatatgaaaggcagtctgttctatctcagctgaggacatttgccatagaaaatgtttgttatggcacagtagagagaccgaagctaccagtttcttaccaccaaacttgtcttggttgaatttgtctcctgtcttctaaactctagagaactgtcggtcttctgaagaactgttcagcgtagtgaaggaaacaggaagagagattgaggagcttagccagttgatcagagggatttaatgggaaaacacacttggatagtgaatagacactggaaaatctgactgtctaatttggattttcccaatatacctgtcatggtaaagtgaaatatctgttggactgaaagtaagtgtgtcagttattttggtcacagctctgctacaaattgacattatgactgggaagtggtggtttgtgcccataactttctccgtgagtcaaagctgtgggattttacatcctttcaacttctctcaaaattcttttctacttaaaagaccataggtgtcatattgagaattcatttcatcaagtattgatcaatccttggggtgtttgccatgatcttgtcatgctttccatctttgccaccaaagaatgtttttgggggtaatgtatgggaagtttgaaatgtgaattatatcacagtttgtatctggaaatcagtgtctaatagataatgatgatagtgactactgtctagtaaacatttactactgggtagaaaagtcaccagattctccacaggagaagattttgctcccttgggacatttggcaatgtctggagacatcacaacagaagggaggagtgctactggcatctagtgggcagaggccaggggtgctgctcaatatcttacattgcacaggacagccccccacaacaaagaattatgtggtccacaaggccagtagtagtaaggttgagaaatcctgctttacagcttgtttaataaatatgcatgctgatcatagaggatgttatgctcatcttgtagctgaggttcaaaagggttaagtaaattcttcaatgtcaagccattcattagagacggagccagcattccattccagtctgtaaagccaattgagggatggtccccaaacacaaaccttttctattttgctgctttgggaagttttcttcatcctcgtttcttcatttttaagataagaagatctgtcctttaccagaagtttgtagtagtatatttgggtgggggtaggcagcggggagaaaagacagggggtttggagattttcaaaaagttgaggtattatgcttaaatgtaatatttttggcaaaaatctgtagtcataagcagtgtgggtgaaatacaaagtgtatatttagactttagtgttgctcatacatatgcattgtttttagattaagaatgagagcttttagtttttgcttctctttgtatctttcaaaagcaatttgatttgctcttctcttgggcatgatggtgatttgtagagcttgctggttgttgagaaatcgaagactctttgtgggttcttaaggatgagagtttacttccacactggcagtaaggtagatgttgggttttggacttagagcataacagaagacatagagatgagagaatggccaaattgcattttagagaaagaagtgcggagaaccccatgagaaaactgtgttttacttacatctctggtcactgataaatctcaattttgggacaaatcctgacagataaggaaggttattggaatgtaagaggtaagaaaaagttaatttaaattattttatttgaaaacttacattttatgagtgggaagtgtggtttaaggtaattggcaagactccctcctctagaatattaaatttttgtcaaaactgccttttgaatagagtattttgggacttgcacattgaaaaatataggcagttgccttgtgtagggctatacttgcccgtagagttttacacttccacagggtgtcgggttttgttctggagacttgtggcagcagctttagctgctttgtgtgataatcagcacacagagcaaaggcacctcagtaatttactgggtgttcattctgtcaattggtaggtttaataaagagagaaaggacaggacatgtagctaatacagccaaggtaaggtgagcaccataagaatatgcaaaaaaaaaaaaaaaccattgaaattatctataaaggagttgaaaaaacagcttttaatcaacattcaataattgaaccttttaagggagcagtacacagagatgtgctcagtgtggcagtcaagttaaccgaaagaatgaattccagcttttcaacgtgaatttcaaagcatcaggaacactgaggcctaaaccttactgtcttatactaacaagagtcttactgttttataataactacattctttttacaggcattactaatgattgcaatttatttttagataaaaaaggttattattgagagtaggattagacactctgaaactcttaacagtttacaaagaagagatgaagagatcttgaggaaaagatgaacttttctatgtcatatccaaccttgatttgaatcggaattattattttgtgtttctttttcaaccttttatgaaatgaaggcattcttgtatttcttcaacatgccagttccccagaaaccaacttcaagatccatggtatcagcagaatttaagtacaagtaacagtaattatagtattgaaaagcccccatagcattcaatcataatattttatttaaggttgggagagcttaagttaattcattttcacaagcagttgaaagattgtggtggaattgactttctttagagaccatatgcatatttaccagttgaataaactctggttgtcagttatgtgtgtaggttggtgagaatatggatatgttatatgagggcagtattcttgtagcgggagaagaagatgtaaagtaatggaactgacagtgagtgcctactgggtttcagacacagcgctgggaaatgctttggtatgtagttgtcacaatgtctctgggacctagatgatattattttcattttatagctgaagaaaaaagccaaaataactaggaagtatttttcctactatatccttatctgagtcaagaaatggatattttttttgatgtatatgtttagtgggggcaacttttagttgttggttgactcgaacacagaattctaaggatttgggtctatcattatttttaatttttgtggtgttgtttttgagacagagtcttgctgtgtcccccaggctggaatgcaacagcatgatctcagctcactgcaacctccacctcccaagttcaagcgattctcctgcctcagcctcctgagtagctgggattacaggtgtgtgccaccataccgagctaatttttatatctttagttgagatggggtttcaccatgttggccagtctggccttgaactcctggcctcaagtgatcttcctgcctcagcctcccaaagtgctcaggcatgagccacagtgcccagcctggatctatcattacatacaaagatttctgctagggtttttttctttatttgagggcaaataattcatatacttattcaaattactgctttaaatatttcccaatggccctaaagagacattggttgcagtgacaggttttggcacaatgggtggttatttcctaataaatagcccaatacctatttaatttgtaaagtaattccttcctccaacagaaaattactttaaaatggaagctggtaggctatcttagttctaattttgcattgcaagttggtactgcaagaggtcacaacccccttttattcagagctattttatctaaaatggtaaaggaacatttatcagtttaaaagccagaactccaaatgtgatttttgcagctgataactcagtttcatgcctaagtattttaattataaacaaatatgtaaccccccgatttaaaacaggtggcattcaaaagttcatttggaacagagtcgtatgaaatttgaaacatttttccatagaaacaatgttaggtttccaggccaacccacaaaagcctatttaaaccatatcgtacaatttctgctctaaaatcatcacggggcccacacaacatatataataatatttctattgggaaaatgcatttggagtttagcttggaatagactagaatttcactggagtagaactgggcattttaaagtcctcctgccattttggcaatgaggatcagcattttttccctaagatgtatctttggttcccatgacctggggtgaagcagtatgaaggctagggcaggcaacagggtgtcttccaagggtgaattcatgattcaacatgcttttggctacaagcaagagactattgaacttgaatactagagttaattctctcacataataagtctaaaacaggcagtttaagcagtggttaatttaacatctcatttaagtcagggttctataaacctttataaccttatagttggaagatgtccaccaaatatgtaagaatcttgtctgtacataacaacctcctaaaggagaaagaatgaggggtgctatcttaatcttactaaataggaaactatttcccagaagccccacctccagcaggtttccctttgcataccattggccagaaccctgactcacagcctgccccaaactaaacactggccaccaagaatcagattgttagaagtggcttagagtctaagttctagttgaagtatagttcaccttcgggggataagcaggtggccaccttctgtcatcactttgccgagctcatttggagatctgtagacaaataagaaggtggaatatctgttgggtgaatgttatctatgtcttttacggtctgcttccatacagcaatagcctagggcaagggcaaggtcagaaaaattttagctttccaagtggctgtgtgatcttgaaaaagtcatgtgcttttcttctgcagactccagtttctataaaacaaggaggtgggatagatttgtttattcctcagtttattcattcaacaaatgttaatgaagcacttactttattacaagcagtattttatgcatggaggttacaatagtgaaccttccaaagttcttcccagatatcttatgtttttacatgattccatgtgagaagctgtggtcctggtaaagctatgggcgttggtgtagggatggtgtgcacccgtgaggccttctaataccgtcaactctagggggagtttttggacgtcatgggttcatttcactttatttatttatgtatttgtttatttatttaagaatccaagagattgatctggttccttccatttgccttgcccccagctgctgttactgacagggtttctgctttccatattgcccattctagagcaacacacaacctcactgcatttttcttacacttctgcctctgatcccaaaaggaacagatgactgatattttctcagtttttctttctttctttttctttttttttttttaacattgttagcaacagaggaaatagatgacagtggttgttgggggaagcttctctgcccttcacactttttcatcctagcactgtagagaaagataaaagaacattaaagcagaaagagtgtgttcttgagtctgtaatactgaggtattatcttcttatatttttgataaatagccagatttgatgatgaggagggagaaaggtgtgttggaggaagttgactcgtggctgagaacagctgcagcagtcctggggaatgagggtacccccccatcttttaccctttgtctcagccatatcaattcctgccacccgggacactgcctaggacaggctgcagtgcaagtgaagatcaaggactggagaggggaaggggctgtgaaggcaacatcaaaggttttggggctgtgaggggagatggcacagagatcctctgttgagacgctgagtttctaggactttcctgaatctcttttttccaagggaatgtatatatacactaacacatatatatatgcgtgtgtgtgtgtgtgtgtgtgtgttaaatggagcaacaagatgaggactggctcatgatatatatgatttgtttcttaagtgatgataaaataaattctgaagtactgtggtgattttaatgacaacactttggaaaccttttgggacatgtagacagggattacagtctgtgttatctacttatctatctcaggggtcggcataccattcatatttactatcagcaagatagtaaatattttaggctttgtgggccatatggtctgtgttacaactactctgcccttgtagcagaaaagcagccatgcacaatagctaagcaagttggccgtgttccattaacactttagctatggacaacttccttgtgtttccttcagtttcatataattttcatgtgtcataaaatatttttctgttgagtttttaaaaaactatttaaaaatgtgaaaacactcttactttgtaagtggtgccgaaacaggcctacaggctgtagtttgtcaaccctgagtctatctggctatcatttgtttatttgttggtctatctacctgtatgttttccttcttccttctttcatctaggagaagaaatctggttccattaaattttgtatgagaaattctttcctatttatatagtcaactactctaaacacttacaaaggggatagagaataactgatttattggatttctggtattgattcgcttgtgtcctgtggttgaacttgtacaagctttatgtattattattattttaaaatactacatttagcattcttatagccaatttagaataattactttgtaaaagatccttgaggaagtacattacatctaataaaaaattatcttggatcttgttaagacttgaaaaccccaggtgaatgatagcgttgggtcagtttttacattctgaatagagcacgtgttttttctgagtcagacaggcaagacttggatagctgtatattactgtttatgagccttatcctttcctgcaaatcaagtgtttattccactcctgaacttaattagcagctaagagctttgtgctttgtattttaaggaagcatgtgatttgttcattagttcaaaagcagattaattattatatctttagtcaccatctgtaaacacatctatattggtgagctctctcctgctgagttaccttgaaatgccctgtggtgttttattagcttcaattctgtgtttattacagttggctggagatttttcaatttagtttattggccacagaaagtccaatcattctgtggaaactaccaatttctgagagtgaggggtttactagtgctggctgtcaatttgctctaaacattttccccaaatcaaactgtatttctgtttggattaaagatagtagtagtttgattataagctaagattttaagcaccctatatattgtccgcattcaaggaagagcaattgggattaaaattagtaatctgcatgaaaaagtatctttctaatccaagttagctccagacaaaactgtgaagtacgtgaacgaaagaggataaatgaatagttattgatgcctgggcattttaatattatctaattttggttttgcagcaatgctgttaggttccaagtgattctcagagaatttaaagaacttgcataagatcattgatagagctgggatatgaatcaatattagtgtgacttgtgagtttgtgcttctcttcaccagtgtctagattgtcagaaaaaaatataggacacctagtaatatttgaattttatattatcaacaaatacttttttagcataagtatgtcccaaatattgttgtcctaaatattgtgtgggccatacatatattaccaaattatttgttgcttatctgaaatttatatttaagtgggtgtcatgttttattattacttgtgaaatttggaaaccttagtagtgtcccttccttctctctccttctctaggcattaagtctgtccaggaacccctttatctgcttccctgctccctctgtacttctggctttggcttattaaccccattctttgcttctttagtttgcagtttacctgctcaggtaaacttaaacattaactggggaccttattctctctggttttcaaagtgtctagtgactattttaaaaaaggaataggattagcctgtttgtcagagctaatgtcttcagtgattatatttttcaagttatgtatttacttaacacagccatgctttaatgcagggtaactctagaggccaaaatttttagaccctgtgcaaagaaaaagaagagcttaagaccattcttttagttattctgatagggtatttttcccacagaacctgttggtgactttatgtttttaattttatctaaaatttgattattattattattcagatttcttttgcttttgattcttgtatactaaacaaattttgaagacaattttcgtgcatttaaaaaaaactttataaaatacttttcaaagaattagtagatgattgaggtctctaacaattcttaaactatattttcacttagtaaaaggtaacacttttacaatacaatttttatttcttgagtaacaagaatacagagggaaaagttacggttctcagtatccaaccatttagctatataccaacatagtagcagaccagacgcttctcagtgaagctaatccaagccagcaccttatgttctctgcccaaactctaggaaacttgtacctttaccaaaaaatctcagagactggcttggaaaccactgggtaaatcagtaggattgttttattatctagttaccttaaggactttaactggggcctcaaagtcttttcagaccactaagcaggaagcgtgtgctgttagccataatgtggctgcaataagaatgatagttttgggtcagctaacagtatgttatggatgaatgtggctcctttcatctctctgaatcttggctttgttgtctgtaaaatcaagcaggggtgggattgaatgatagccgaggtctttattagtttgttactggcttcaacagagttgggaagcctcaagccacatgaacctttctcagaactgcttctcaggacaccttagggtagctgagtgattacaaaaagcatctgaactatgtgcagatgccttggaatagaagcaggggatctggaaaggctgttccccaaggtctctgcagtcagccatgcacttagatttgactacagacaaaacagatgtattcaaaaaattgaatggcatgttttacctaaatggtaggggttagggaagatagcttcttaatgggtctttgtgccatgtctctttattccttatgattagtacagctgaatcctgattctctttccttttccttgtcttccttccctctcttcctgtctctctttttttctccctccctctctcattgctcatttttttccttttcttcctttcttgccactctaacaggctgagaacaggacttttaggagctagctttccagaagtgatatagttacattgccttatctggatttccagagcgcatttctcctcatgtgctttttcgcaagagagagaacataacataagcccctaatcctttcaaatatgttaaagagaacaatgctgtgattgaagcaaggagactgggatttgactctcgtgtcttcctcttacctactatttgtatggctattgaagaagtcactgaatagatttcattatatctaaaatgtgagtataatcctcattgaactcttaggatttcattaacactgaaattctattgaaaaacagtttttaaactgatataccatggaaattattttttcatgtgcctaggtaggtttgttttctttcttctctctgtaattccagagttgttataatgtgtctttctctcatgctagactctaaattcattgagagaggaccttgttttattcaccttttaagttttaattaataagcctatagaacctataaaatgagtcagcatttagtagggtcttatgtgtactaatgtgtctgaaggcatgtacacataaatttaactaatttttattttacttatgattctgtccagtttttaatacaatattaaaacctgaggaaagcagaatatttaactttgttattatagttgattaaatactttactgtctttttgcatattcaattatctgtagcttgtgcagtcttgtaagacactggttgtggtactcactcattcattcttaatccattcatctatccaaccaatagttattttccccattaactgtcctctgaattgtgctaggcacaaaacagatgtaaactctgacatcatgaagcttatagtcaatggaggagaaggcaataaaataagtaaacacaaatgaatatgtaatggcaaagtgatataagtgttagggagagcatccggtttcaagtgaatgagaataacagtgtcacccactctagaatggatatatttaaattctttgaggaagtggcactgaagctaagagagatctactcttgacgatgattagttcttggctagacaaaaccaaaccaaaccaaaacaacacaacggatgaagagtggatcagacatgttacatggtacatacagatggagtatcccttatccaaaattcttggaaccaaaatcctttgaatattttcagaatatataccagttgagcagccctaatttgaaatccagaatccacaacccagaatgctccaacgagcatctcctttgagcatcatgtcggtgctcaaaacgtttcagattttggagcattttggatttcagattttcagatcaatgctcaacctatataatgctcaacctgtataaaggccctgaggtaggaaagagccatgaggactcaaagaattgaaaggtaagcatgaggaatagtggcatgagggacggtgatgctgttcatagtgcccaattccccaaatgttttattcccttactaaattactccgttgtagttgctttttttggtgtttcatttttcaacatcctcatatgcctcctttcttggtaacagctttattgagatataatttacatatcatacagttcaaccatttaaagcatacaatttagtggtcgttagtatattcacagagttgtgcacccatcactacaatcaattttagaacaacttcatcgctattctctttagctgtcacccctaaatccctccattcccgatgccctaggaaaccactaatgtactttttccccatttatctattttggatatttcatatacatggaattatataatttgtgatcttttgtgtcatgcctcttttaacaattttctattgcatgttcatctgcttttcatctttgctcccaagttaccgcagttatggacttttttttgccttcagtgtgctaccttgttccagtgaagttatttctctttttgtttccctacaccattagcaatgtccaaacttcgaagagtttccatattgctaaatgaagtcataaaatttatattaatgaaaagttgtctttctagtttcttataatcgagtgtttagaaatctttacaaatcaccagttggttatttttctgttgctcaaatttgtgctctttcacctaaaagaattaggaatccaaatgagattttgtactataatagacaaattgcacaaagcttccatccacctctaaataaaaggagaacttcgtcagcatacattttgacattttagatggtatgtgtaaagaacacatacgtacccaaatctcttccagtgatttctcaaaaggtgagctctctgctttaaaaatagaacattgatgattcagtgcccaatatttgttagtatgaacttaaaaaatattgattgattgataactaatagcaaaatttggttgttgggtagatatctgcagtctgctgaaaatcaaaatgttatggttaaagaacgagtttagtagcactaatcagaattccttggtttcttgggaaattagggggttgctgctttactaccaaagaaaaggaattaagaagtattaataatcttcatttgtttttggctagacaacttgtgggatgcagtagggggtagagtgtatacatactattaaactatcttctgaaataaattgtagagggcattttttgaaggcagaaaaggaagagtcagtgtgtttcctaagccaaagctttggtcattgtcactactccctttctgttaagcaaaggacagaaactctgatgttacgaacaagagaggagggtgaaggtgaggcggtgagagcctcagtgctagcaaagggttttagacgcacactccctcatggagagcagatctagtcaggcagtcatgttcacacatctttggtctttgcactctgagcaatacaaaatttaagaattatggttggaattatagataattgggagtcaaaatttaagacaccttcttccccaatatgttttaggcaaagaagaggctggcgtcaagtatttaagagctattttagctaatggcaacagatagattatggagaatcactgcttgttctgtgggccaggtggtaattacagacttagagatataagagttgaatgtgttccattctctaacaccttcacacgcctctttttgaaattctctattgcgtgttcatttacttccctccctttgctcccaagtcacagcaattaagggctttttcttcccttcattgtgccagtgtgtcccagtgatgttatttctcttttcttcagacaatgagtagcttccaaaatccatgatgatctccaaattactaactacagaagtcaaatggaactacattcaaggtgtttagaaactctcataagattgtaataatatgaagaataataggtaaaatattttgtcatatctgaatatattcaaaagttgtgattgaagtctttttttctttttgtttttgtttgtttgtttttaagagacagggcctttgtctcactctggtgcccaggttaaagtgcagcgggtgatcacagcttattgcagcctccaacttctgggctcaaatgatcttcctgcctcagcctcctgagtagctgaaaccgcaggcacatactaccacacctggctttgattgaagtttttagcctcctttttgtgggatccaaaaacattcctttctgcattatgtggaagaaattaataattttcaaaaaagacagcatgttccttcaactaagtttattcagaaaatggcctgtattcattaaaagaccttggctgagttctttggacctgtgaggccttagttttattgtcagtaaaataaagagttgggcctagattggtttttagtaaggtgattggtgcaagaccttttcaaatgatattgtttctttatatcagaatcccaatgtgccctgctcccccttccctaaataaagtgacttattttttatttgattttacttttgtatagcaccctaaggttaacagtctttcaaaataactctcagaattaaatcaactggctgtgaactttgggccctgtcctaactgagtcctctggtctttaatgtagctgaaactgctcaccatggaaacagctgatagcagtggtctgtttgtcaaggaaagcaaatcttgattcagacttcttcccaccctcagctcaccatccttagcttctgtcacaaattgcattggaaaatacattggaaaaacacaaaaacacagaaatatgaactctggctcaaaatagaacaaattccacaaaaattgcccatggcatatcagtaaaatacaggattaatcacaaaaaataattatagtctttggacatatcagaatctcataatatatttagaactgttcattcctcttatcaccctcttaagaaaaaaaaatccactgagcatttagttaagcagtggtgatattctagatgacatgtgagaagacttgtcaaatatccatgacttgaaactaaaaacagcatgacttcttgtcattttagggagacttaggagctaagtctggtagctttggcatcagcttatttttagcagtgtgtgatgtctgtttttcctggttattatccctgggctcaattttgcaattataggatgcacatgttattcagcagatatgaacgttttcacttagcaaactgtgtacgtgaacacctttttaaatgacttaatgggctcgagttttgttggttgttttgcatttaaaatggcacttgagacagataaccaaaagcataaaatggaaaaagtgattattgtagaaaaatgggaaagcaacatgtttctgtaaatgctttcgtgtcgcttactcagagaaacaccatttgactattggaagttgctatgggaagcatgcaacatttccatggcgttacattttactttcttatttgcttgcttgcagttattctttaaaaatatctatatctatatatctgtgtgtgaatatacacgcgtgcacacacacacacacacacacacacatctctagcctttcatccatctattttttttttttttaatgtgtctgagcaccacttcttaggcaaggtcaacacagtaaaactcagctttgattataatgttcaccctcctggaattggtccattacaaccattgtgtgaataaccttgtagaagtttcctgtaaatgtgttggctccttggcaccatagtgttctcagcgttcatactgtgggactgctttaaagttcaactccccttagcaagagccttggtatttcagagactaaattatcttgtggctgagtaatgccaagtatatacctgctttattcctaattctgctggatagcatattattttttattaatgtcatggcatatattagttattattcaaggactgctagggaaagaaatgagccattggatgaccatataaattcctctataactctgatagatcaagaccaatggagctagtgcttaatttccaccattaactgtactgtcattatcaaaattcatggattgaatatacatagtttagaaattctcacgcatgactctgtttgaagcagtagtaacttcatatgaatttttaaaggcagaaattagttacaaggactgcataaaaggaaaaaagcagatcagttgtaagttatcaacatagtgaacaacattattactcattcttaagcactaggtgtgattctaaatcagctttctgtttctagttctcaccctcatctccatgcccgttcttaccctcacccaaataatatttgactgataccagaaatattcttctctctttatttgctacattagggatttcagagggaattcttttcatccaggaaaaagaaaatcaggccagttttgaggaactaaaaataaagctatgcaaaattgttttcaaagtggaattcattgccatttgtttttatgcatgacaatcctttagaatatagcattgaatcaaactatgattctgacttcaatgatttttatagtcagtttacgaatattcactatagattttcttatatatggtttgtatctaaacagatctaatttaaatcctggaagcatgatagtaatagtagtaatggtagtgatataatgagttcatcatatgtgacagactgtgataaattattttacatctattttctccttaagttctcactacctttttcaagtggatactgttcaccccatttaaaatgtaatgaagtaggaaatgtcttactattttgacaaaaatacaaaatcctcttaggaagataattgtgtttgtttgcaaaaatttctttcttttttttttttttttaaaaaggtagtatttaccatattcttttttttttcttttttttattatactttaagttttaggatacatgtgcacattgtgcaggttagttacatatgtatacatgtgccatgctggtgcgctgcacccactaactcgtcatctagcattaggtatatctcccaatgctatccctcccccctccccccaccccacaactgtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacagtttcttaatccagtctatcattgttggacatttgggttggttccaagtctttgctattgtgaataatgccacaataaacatacgtgtgcatgtgtctttatagcagcatgacttatagtcctttgggtatatacccagtaatgggatggctgggtcaaatggtatttccagttctagatccctgaggaatcaccacactgacttcgacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgtataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttctgctgtgcagaagctcttgagtttaattagatcccatttgtcaattttgtcctttgttgccattgcttttggtgttttagacatgaagtccttgcccatgcctgtgtcctgaatggtaatgcctaggttttcttctagggtttttatggttttaggtctaacgtttaagtctttaatccatcttgaattgatttttgtataaggtggaaggaagggatccagtttcagctttctacatatggctagccaattttcccaacaccatttattaaatagggaatcctttccccattgcttgtttttctcaggtttgtcaaagatcagatagctgtagatatgcggtgttatttctgagggctctgttgtgttccattgatctatatctctgttttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattctgtgaagaaaggcattggtagctggatggggatggcattgaatctgtaaattaccttgggcagtatggccattttcacgatattgattcttcctatccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataggaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacagtatgttgaataggagtggtgagagagggcatccctgtcttatgccagttttcaaagggaatgcttccagtttttgcccattcagtatgttattggctgtgggtttgtcatagatagctcttattattttgaaatacatcccatcattacctaatttattgagagattttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgagaatttttgcatcaatgttcatcaaggatattggtctaaaattctcttttttggttgtgtctctgcccggctttggaatcagaatgatgctggcctcataaaatgagttaggaaggattccctctttttctattgatcggaatagtttcagaaggaatggtaccagttcctccttgtacctctggtagaatttggctgtgaatccatctggtcctggactctttttggttggtaagctattgattattgccacaatttcagatcctgttattggtctattcagagattcaacttcttcctggtttagtcttgggagagtgtatgtgttgaggaagttatgcattagtactagattttctagtttatttgcatagaggtgtttgtagtattctgtgatggtagtttgtatttctgtgggatcggtgatgatatcccctttatcattttttattgcatctatttgattcttctctctttttttctttattagtcttgctagtggtctatcaattttgttgatcctttcaaaaaaccagctcctggattcattctttgtaagggttctaaggagaccatgagccctgatctattaatacctgtgtgcctccctctccctctctccttgcaaggacatcttctgctggtgccaagacatcagaatgagatctagattgcaaatggtgtaagaagggtttagaactcctggttttaggagatggagggagtgtggaatagagatgagagggagagaaagaaatggagccaaatagcaagatggtgggaagctgtagtgagagagagagagaggtgtgtgtgtgtgtgtgtgtgtgtgtgtgtgtgtgtgcacatgctcatttagttatttgggttttggctcaagtggatacagtgctggagagagcccaagaagcagagtggggcaggctgcaacctttctaggaactcctttggacatgcaccagccaaaaaattaggggctcaagtctatttcattaagaatctaggttggcagggaaatgcccagggacatcgctcacatcacagtgtaagaaattgagaaaaaatgctctcctgaagtcattcaattaatcaggggcaaggatggaatgcaaagccaagtctctcaattcagagtactggattctctttattataccttcctggcactctagaataatgattctagcatgagacatggtaatctcaacaaataaatgctatgattatgtttatgcttactagcagttctagtaatcttccatttctaaacttggtagtcaggtaatcagatgtgttaaaattttcttttaaatgattcattctagacagtggaaagtatgcttaagaatattaaatatttaattttattgggtatcaccatcatataattataatctggacttttttttttttttttttttttgagacaggctcttgctctgttgcccaggctgcagtgcagtggcacaatcttggctcactgcagccttgacctcctgggctcaagctatcctcctgcctcagcctttcaagtagctggtactgcaggcatgtgtcaccacgactggctaatttttgttattttttgtagagatggggttttgtcatgttgcccaggctggtctggaactcctgagctcaagcagtcctcctgtcttggcctcccaaagtgttgggactacaggtgtgagccactgtgcctggccctggacttcttatgacactttattttatcctgtggcaccaagtaattatgatgctttacttataatctatacacactacgtttgctattccttttttccgtgtcagggaaaagtaaagtggcaagttttacaaactgttttgtaatatgttggactgtatgagacacctctagtaggctgaataatggcaccccataaaatatccaccttctaatccttggcatctgtgaatgttacctcatatggccaaaaaggattttgcaaatatggttaaggcagggagattactctgattattctgtattgtccaggtgggccctaaatgcagtcacatgtatcttataaagagggagacagaggggtatttaatacgtacagaagggaagaaggcaatgcgatcatgaaagcaaagactgggcagcctccggaagttagagtcttcaaggaatgaattatctcctagagcctctgggggagaacagccccgccaacaccttgattttggcccaggaaaactgatgtgggacttctgtcctccagaactgtgagagcatacattctgttgttctgtggcacaacggttgtggtcatttgttatggcagccacaagaaatgaatacaacactgtggagaagtgtaagcccataagcaacctcagtccatgatgaaagccatggctagatgtaggtgttttcccccaaagccagggtactcattactcaaataaaattcatatcttcccaaaatgaaatctgcaaacatcccgggacccttctacctgggaaaggaccttctgataggaaaacagtgacagcatattaatctactgcttggggaattcttggcaacagggatatggcctccatcccatgggagacagaactggcaaaagaagaaattgtggatattgttgtattttttaaagatggaaacatctgcataaaagttattgtacagggttttctctttgagcccacaaaaacaagaaaaaaaatactgtcttccaccgaactttaaaaaagtcactcttagactagatccagattttatcccatctcttattattttacttcaaataagcaaaattaggaaactgtcaatactttgtattatgtaggaaaaattgttatacattatgcttaggctattgattagtgaatattttctttttagctgtgcagttactatatccatctaattatgataacagatttttaaaataagttattggttggtatgcagtatttgaaagaatgaaattaaccttttcctttcattatcaaggattttaacttacatgcctatgtcactgaacatacacatatatagaatacatatatacactgaatatatatatatattctgttttttatttgaagttctttagtaataaaatatcaccttaaaaacaaagcaatttctttgacacagcatttaatttggaggtcactcatattttaaatggggagccaaactttaaagttttttttttttttttaaagagagtgtctacaatagaatttgacttcccatgccttcataaagctaaaattctcaatgagcagcatttttatttaggataaactggcctctatgaaaacaagcatcttcagcttttgagaagttgtgtgccctgattagcaagcaagccacactagactttaaaattgaactgagggccctgctgaagcacagcttctattgttctgtaatgagtgttttgcagagtcctttcaaaagtaaactgtattgttcccttgctagtttcagtacatctgaatgaggtgattatgttccttaaaaagcactttcaggactgcagaaaaattatctactttaaaaaacattttttccctttatctggtgataaattttaaaaccttgaacatttcatgagcatcctggcaagaggtttaaaattatctggaaatcctgcctttgatccaaggtgcagagagtctaaaaacccatcagagcctataggcaggtctctgctgcctgagctgctgcttgagcaggaaattttgcatagtaaatactttaaaactttggtattcagagagcaatattaaatctaggtgaggactaacatctctgaatagagcaaaatttcatgatgccagggtacttgtatagctattgacagcctagtttttcaaataaaattttaaactgctggggcacttggagtccatttgtatttttctgatgcaatgtccgtggggctttcagaatagcggggacacgggtgggattggagctcttttttttaacctcttttcatttccacatgtctgttattcttagtgacttgtatcatttccgtattaccaagttgaaacagccacaatcttggccctgctgtcaataaatttgttgaattatttattcatttcatttatttatttatttcaataaataatgtcttagagcaggaccaagactgtggctttatagatttgaaatattttagggaaagcagagtttacaataaaggaggcaaatattggattggatctagaataccctatcagttcattgaatcataatttccccacataaaaccttgggttcttaatttatcgaattgaccctagtcctttattgtgtcaggacttttttcctaaatcctaattgagtgacaagttctatttgaagaattccagcacttcaccactctgtgtgtagatgagttatttttctgtctcctagagagtatagagcaaggctacaaagagcctgtaccccaagggtctcctgcattttccgatgcccctaagcatattttaggtgatatagaaaggattagacatgtcttaatttggcccaaataagtaacttaatttggcccaatgaaacaacccttgaaatacgttgtgtttccaaaacaatcagtaagaggagagtgatcccccagggagcccctcacttctcctgctcatccttctgtccccccagtggcaattttcattcttatccctgaggttcttctccctattaaaaaaatacacgtttgaagatgaaatatactggattcttgtgcagtgccatgacgtcttatggagacatctgttctgttgttactgggatgaagtgaacgtcaccacatggaactttgttgtgcctccctcaccatgcaagggaattagagttttgttaattccctagttgtttctctgctttaatcagagggacaactggtcagagagttttgtccttcctgggaccagctcattttaggccattctaatgactttgcagcttgcccttgggcccaggcctttgatttcaggtggcccatagggctgcagacttttacttcccttgaaatgaacagctccatcatccatcctcctagaggacgtggcgggtcaagactattcagcttcacgttcacaacttctgcctcctcctctccctgctcccaagtgtgtggcgtaaaccgatagcagccaccattatatgatgctgagggagcctccttccttataaccttccgttgtaacagctgcatccacagaaaccctggacttagttgtgagatatattcagtccctccagggcaggggatgtccttcagttccatccttggatccctagttttgaatcacttttgatttatagtaacctgggtgagatgcttccaaaactccatcccctgctgcttcatcacctaaatgtgacactagggcaaagatctccccctgcttttgtaaactggtctatcctgtgcacctacgcctattgtcaaattaataaatctctataatggcatatttgtattttgtaggaattgctgatagtaattcttttcagaacctggaagaacattcttcaaagaaatcaggaaattaagttatattacttgttaattcttaccacacaactgactacattaagacatttttaaaaaagctctatgcgtatgatgcttttggtcagtctgattatgaaaatggtatgttttagaagaagttctatttattgacagggtggaggcagaagctgtttttatattaccatgtcatgtttttaagtatgtaaataagatgaattgctgctatgatcaagtaaaaattaaaagcaatgtaataaattcatagagagtgagtgtttcttgggaggccgaggcaggcagatcacaaggtcagaagtttgagaacagcctgactaacatggtgaaacctcgtatctactaaaaatacaaaaattagctaggcgtggtggcgggcacctgtaatcccagctactcaggaggttgaggcaggagaattgcttgaactcaggaggcaggaggcggaggttgcagtgagccacgatcgcaccattacactctagcctgggtgacagagcgagactccatctcaaaaaaaaaaaaaagagtgtctctttttattttacctattaatttggtgcacagtatggctgtgcatgatgtattcttagtgtaggcattatacaaaaatcctgtgccatgtggcagataatctcattagaagaagaaaaaaagcctaaatcgacatggatcacctggtagtgtcacagtcttctctattgctggatctatttatgcaaaaaacataaaatcttcataccctcacgtctatctacatgtcacacctggttttgattttaatgactttcagactcttcagtgggaaggaaataaataataaaagcagtgttattgaaaaattctggaaataaaaacattttctgattatgaataatacatgtttattttagaaaatttggaaataaaaaaaaggataaacaagataaagtcaccttaaataccagctctaagagggatccattaacactttgaggtattttcttcccacagttcatggaaagtgaaggcttctgaactgcttgttgttcctcattctttgttcctgattactgtaactggaaccttcttctggtccaccaaatcagaaaccttcggggttatcttggacttcccctttcactcaccctgtcatcttttggccctgtgggtcctacctctgtggatttccctgcccattccctctggttcaaccccactcctattattctaattcagtctccctttctctcttatttggaattctgctgcagctttctgcccagtcttcctgtacctagtcataccctcctctgctatatgcaccattctgagaccaccatatttttttttccctaaaagttaaccctatgatgttgtactcttgtttaagcctctgaaagcctctctgctctccttttcgtgatctgccctgataagtttcttctttccatctcttccttagcctcactctctgccttttctctttccatctcctctccagccatcatctcagtcactgtgctagcagtttctggatcatcctctttttttgcttgcacagtcacacattctgttccctgtaccttttcttctaaccaccttgaagtttcaaactccctgaggtctgaggaatgaagtagaaagaccttgtgatactgtatgtttattgtaaaaatgtattttgaatgacatctttctgttcctcctgtagaagtcagcttgtcatcaccgactctgggaacactccctagccacaaagacttaagtttcacttgctttgtgtttccacaatttatggacaacacttagactttaggtcagtaagtgatcctgaagatttattcaggtgacatccctgagaagcaatattttaggctgattttatttggacagtcaacaattgatatggactatatgtcatatgtcaagcactgatctctgattcctgtgaattagacagacataatctttgctttcatggagcttgtagtctggtatagtctgatgtaggcaagcactcaataagaagcaatgaataagcaagataatctcatggagataatttgaagtgataaatacagggtgatgtaatggcattgggtgcagttatatggtttcaagttgactgagctggtaagggctgtgctgtagtacctaccagtatattatccagacatatgtcaatcatattactaagttaacagcatttggtagtggaagctgtgcatatttgttgggctaatggttttagggttaaaaccttatttgaatgaatagaggatatttaagattggaaagaaacatgatagcattcaaataattgaatgactatatattagtactataacaaagagattctggaacactccagaagactgactggagcaaaccaaaaaatagaagttacagaggggtatattttaacttaatataaggaacatcttttaaatgtttatgattttctcatcaatagaatggatgtgctgaatctttgataggggttgtattcagataccggtgatctgtcagaggtgagtgaggaagttcctctaaaggagagcaaagtagcctagatagtttcagagatctctattgtgttactttgaggaagctcaacctaggagaaatagaggtatcccgagaggagcaaatttagggcagaacagaaagaccccacaaaagaggtcaatggaacaagagatgatatttctctggaaaaagggcacatagcaaatatataagactgttgattcaccagcaaaagagtcttcatgctgattggttgggaaaaaaaggaaacagaagaaaaagagatcaagaaaaggaaatgtcttattgaagaagagggaccctatcaagtaattccagaatgctgaatgctgtcatgctctgaataaatacggcatcaattaaagggataagagctttgattataacttaatgtctggctgagctatttcttacatcactgtttcttaggtaatagtttttagtctattatctaatagtccattagtacgttgaatagtattctataaatgaatctagaataatatgtttaccttccattttaggtatgatatggcaactcttcattttcaatactcacagtggttgattgagacataaatttatttgggctcaggcttggcttggtcaggaaaacaacaaaggaaaaagtttttcttcagagctgctatgtttatgcttttatgttgtggttggcattttggcagcataggtattaagttatgtaccacccaaaactacttaaaattagttttctcaggcttaaaagaaagagaccttggttttttaagacattgaataagctttagttcagcaacaacgggctgcagaaacaatgcttttaacttttatttgtgtcatatatttaagttacacattattttcgattcttcttgtatttattttttccttctagcgaaaacaatttggttccagtattttaagttattaatgcttcctagagaacaagtttaagttttccagtttaggaggaaaagcattcaaatcagaaaaccccctcatttttaacatttttcccaagaagcagaacagtcattttttaatcctctcataatgccctgggggcgttagacagacattgtcccttaaaaaagagaaaaataggaattgcatcatgtttgatagaagtataagtaacaagggaaaaatatgaaaccacaaaaagtggatttatttttttcctcaatatttgcatattttagcaaataggtttattgagcctcattggtggagggttgacaaggatatgtaatgttattttgtctatttaacaacttacagcttatttaaactctttttcctaaatgaatcatctccctttttttttgtctgaaaggtgacagtatatttattatggtccattttgtaaatacccgcttgcaaatagacctcttcatacctgggtgtgcctctttggagacatgcagaagaaaccctcccaatgtgaattacttcttgactttgcagacttaagatgaaattgcttaaaataaaaggaaaaataaaaatacactgcttgttttagtgtacatttggaaggttacaaaaattggattaaatattgatgtttgcttttaggtatttttgtcttttaattggcaagttaatagggatactttcttgggtgagatcattttctgtgaacttgggaagaatcagtttgcttgttcgctggtggacacatggaaaatacatcattggagcatatgttgtttatttttttattatgaaatattttagcaattcagaaaaatatgaataataaatttaataaatactcatctactcattatatgtttatgttttgtcttacctcaggactcattttttttttaagcaataaggcatttaaaatatagttgaagtgctctttgtaaaatttcactcactgtccagagttagccattatcctgagttgaatgtggtgtttaccattcccatttatctattcttttaaatataaaatatttattcataaatattacgatattatttcatatgttcttgaactttatatatgtggtatattatataaatcatttttgattttattatgtcattaatttactgtaagtattgaggtgtatccattttgacatatatagctctaggtccgttgtattaattgctgtgtattattctaatatataaactgctacagttttcacatattcattctcctgttgatggacatctagactgtttccagaatttctgttctacattgtcttgctgttaatatttttgtgatttttctcaagaagatgttggggaatttctctaggagtggaattgttgggtcacttactagtttcctattgctactgaaacaaattatcctaagtgtgctggcttgaaacaacagaaatgtattatcttcgagttctatagatgagaaatctgacatggttcacactgggctacactcacggtatccgcagggctgtgtttcttctggaacctgtagggaagaatccatttgctttccttttttggcttctagagagtgctcacattccttggatcatggtctctctcctgcatcttcagcaggactgaagaaccagcactgctgcatcgactattattccataggcacatctccacttctgcctgactgtattctgcctctcccttctactttatttatttatttatttttgagatggagtcttgcttttgtcactcaggctggagtgcaatggtgtgatcttggctaactgcaacctccgcctcccgggctcatgcgattcccccacctcagcctcctgagtagctgggattacaggcgctcgccaccacgcccagctaattttttttgtatttttagtagagatgggatttcaccatgttggccaggctggtctcgaactcctgacctcaggtgatcctccctcattggcctcccaaagtgctgggattacaggtgtgagccaccacatctggcctctcccttccactttttagaatccttgtgaatgcgttgggccattctgaataatccaggataatcttatgattttaggtcattttattagcaacctaaattctacctgcaaccttaattccccttggcatatgaggtaatataatcaaaggttctggggatatggtcatgaatatctttgcagggggagggtattgtacctacacagatcatagggtgtcatacattgtccacttgacaggatagttttaaattgctattttaaatggtgtgtgcatttatactgtctctgaaagtgtatgaaaattttaactgttccatatccttgccaacgtgaggattataagactttaagatgttacccaattggatggatgtgttttggtatctcattgagcatctttccatataattattagctgctgaaattgtcttttttatttattgcctgcttctgtccttttcttatttctaaattgttctttgttttgttttcttactcgtttatacataagaaaaaagaaaagaaaaaataattagtagttaattataatatttaacaacatattaattcttataataattaataattttttctttttttttttttgtttagagtcagggtctcaccgtgtcactcaggttggagtgcagtggtgtgatcataactcactgtagccttggcctcctgggcttaaatgttcctcccacctctgcctcctgagtaactgggactacaggcacgtaccaccatgcatggctaaggttttttatttatttattatttattatttattattatttttttttgagacagagtctcagtctgtcgcccaggctggagtgcagtggcttgatctcggctcactgcaggcttcgcctcccgggttcacgccattctcccgcctcagcctcccaagtagctgggactataggtgcccaccaccacgcccaactaatttagtttttgtatttttagtagagacagggtttcactgtgttagccaggatggtctcgatctcctgaccttgtgatctgcccgccttggcctcccaaagtgctgggattacaggcataagccactgcgcccagcccagtttttcatttttttaaatttgtggaaatggcgtcttgctatttttgcccaggctgatcttgaactcctggtctcaagtgatactcccgcctcagcctccccaaattctgggattacaggtgtaatctaaagtgctcagccataatcccattactaattcttgttggttatttgcattcccatatttttcctagtgtgatttgtctttgcactttattagggtttttttttttttttaagtgcacaaatattttaattcaaagtcggcacgttctgccatttcctacttgaagtaagatatccctcttcatttttaaataaagagcaccattatacattgaaataattttatttgtatctagatatatatgtttctattttttttttgagatgtagcaacaaaacagtctgatttattaggttggtccagttttatataggccgcaattgagaactgtgtaatttaaagagtgatgggtttataaaatgttattgctagcaaaaactttagagatgatctggtctgaaactgatgtccagagagacagggaatggcgattctagaagcgcttgtattgacaaagtgaattgcatacacactgcaatattatcttcgttggctaagggactctgccttaccttgaaaagcatgattataaaaataataactggacatcaattttgctgagaatcttctcttatctctggagtgcatattttctattgtaaggcttttgtcacaaacatacctctactgtgagccaggtcccaaaagggacccttactttagcaaagtcccacaacttttctgtctgggtattcatccacatcactctctgttccaacactgctactcctccaactcactaaacaggttttattttcccaatatcactcgattctcagactcttgaagatcagagataaaattaagtgcatcttttatgcccaaaataagtgtgtcaagattttttcactatttttttcttaaggaagtattgcagaggaacttaagagtgagtgacagttgacaaaaagaaatggttgcctggaaactggcaatttaaataactaggagctgatatgatttaccagcctgataaacagctaggactttaatacaatctaaagggctgctacagatgttggattgagctatttatatgtgttaatctgtctcagtctattttaatacatgcatatatatatgcattttttttttgcagaactggaatataaaagcaaaggctgtatctcttcccctatatgacattaatagaaataatagaaattgccttcaattaaatgaattgttttggtccccttgtttttatatagattttcagtttcaaaggtggctttctcactcagggggaatagatgtcttgtggattgagtgcggagtttgttttgagttctgacactgtaattatatacttagtaattgttaccttgttttttcaggttttatcatttgaaactttactccatttgttgagatggagttgcagatacttttgattcttcacaggaataatgaggtttaataggattggttctgagtgagttagcttaatcaagtagcctgttttactgatgggatcattaagaggctttatcctctcatgggccagttagtttcctggagcaggtgaatgtctttgcagcctccttgatcctcactagacatctttcacatggttcttcgaagagatgatagaaaagctgcagcctatattgtactgtaatcatagtatagtaacccagagttccctcttctggcaggaggtcagtactatcattttgtgtataaataactgatggcatatttgtgaagctgtctgtataaaattccactatctccttgggaatggaatgtgctacatacaacaaactatcatcatgttactagcataaaacttgagataattttgaggataattttgacagtggaaatgttttatgatatgaggaatataaaaatagatcatttaattcacagaatagttgaaggacacagcaaggtaatttttaaattgtttcttgcaattgtttacaattcactgagcgtagtagctatgacttggagaacttctgggaaaggaggacatttttaccacccatgcatgtttgaataaatttcagtctcctaaagctgtgcaccagctctttcatgtatcttcccttctacctctaatcacagtgagaactccctactcctaattcctgtagcacttgtgctgtcccatttttttttttttaaagaaaatagctatcagggctgcagtgtttcacaatttgaggggcagtttgtaacacagaggccctgaatgtcataatgtctcacatatattgagcagtatgctaagtattttaaatatattatcactcatccctagtgaccctgcaagtaactattagagccagcaacttaccagtgaggaaactgaaggtcagaatggtaaataatttgcctgtgaaaatacggcaattggaatttgcattaaggtcagccagactccaaagtcagggttcttttccttgttctgctctctatatatgtttgttattttgtttcttaattgttcatatgcatatgttgtttctcttgtgcttctcatactttagcttagttaagaatcaccatggaaacttgtttaaaatgctgtttctgggcccttgtcctaaagattctgattcagaaggtctcagataagtcctgagtgtctgcatctgcattttctgaggggttcttggactgtactctgagaaatcactggtatgaaatctgggagacaggagctatctgaacaactcccccagctctgaacattcatagcaagcactcaataagtacatgttacattcaagcagagctaacttgctcctgtgcaaaatatagcccacaaggttccatagcatgaacttggattgttcttaacttgaatataaagtttgtgtaagttagaaaagtcaatactaattatagggtgaagttcaaagaacaatatctgatatgattcattttttacaaattggtgtattctggaaatttaggtgtatcctaaattaggtgtattggtgtgttttcacaaggaagtttctgtagacaaaggaacagcattggctagaaaagaaccagagagggacggaattgaagttagttgtaggtataaagtagggttctttggaaggggaggaggagatggagataaagatgggagatgaggttggttcaactcattagtgaaggtaagttctttggaaaggggccaaataaccagtggcctaatcaattgcaagggattctggagaaacctagtagaaaagagggtcacagatgtgttagcggtgaaaagaattggaccaaacgcacagacaaagcaaggaaagaataaagtgacaacagcagagatttgctgaaaatgaaagtacactccacggggtgggagtggcctgagcataggggctcaagagccctgttatggaattttctggggtcaaataccctctagaggtttcccattggttacttgatatacaccctatgtaaatgaagtagcagcccacgaccagtctgattggttgcagaaagtgaccaatcagaggctgaagtgaagttataaagttctgtacaaatgaagacttggccctctaccagcctgattggttgtgggaggggtccaattagaggtactttcaattcctcatctgccctgcagaaaaaggtggggagggttgcaaagggagtagcctttggtcctttcgttacttgagcatggaaacttggggttttccttttgatttagttctaggaagtcagtgcaaatcggctttagggtccctgcctctagaacctattctcctgcctcagatggagggataaggagtaaacagaatcagtgccaatgtgggtcttggctggggagggtgccatgtacctcacatctttgggcaatggccctggtgacttaagactcatactggtttccttctacattgtgtgggtattttctgttatcacttcttcacctgaggggcacatctgcttgtgcctagagatgtgtcttggctggcttaaaattgtatggactgctagcaacaggtagaacagtgagtaaaacgatcagtgatatccttcccaaaatagagggaccttaaggtctattgaaattcccaagccaatctgttaaaacatattcaagttctgtatagaaagatctatacaatatccggggaatagacttcatgcttcccttcacatttctataaaatgatacttgtttctaacttacagtttttttttctattcgaatgtttttctttctattaacatccaagtgatttttttatatagctaacacgagtgaaagattaaagtaaacatggtatattcacaagcaaaggatagcacagtatatttccttagagtacacatttgccttctaaaagaaagaaaaagaatgaaaaaaagctttagtaattagatacctgctgtaaccctagtggagtgagaaagatgaatagttgtgctgcaggactctgtgccacagtgagaggcactatgtgtcactgttttctcttgggatgaaatttggcctgaagtaaaataaaatttctgtaatgataataacagccaatgtttttgagcaccttcaccttaccaatgattactttacatttatttccttcaagcctcacaatgacctcataagttaaataattcatgtttaagcaactgaggctcagagaggttaattgacttccagaccgcctagctagtgaaacattttacaagagcactttgctcaacgtggggattatcagatcttcaagagttgagttgcagcattaaagaaatgtgattaaagaaatcacagaattttaaaaaatgtacacaatattgaagcttgaaaaagagaatcatatcactcttaattacaatgatggctaaaggtcttttgtgtttggctagctgatcataacccatgcctccacgcaggtgaggtagtagaccaggggagacgggttcttttcaacatgcttggtcggcagttttctgcagggaaggttatagcgtgtgagttacaaagccctcctgctgcacaggtatcagaggttgtctgttacaagttccttcacttcgactattacttccttttcacaattctattttggacttctgtccagtgtgtatttacaggtagacaaagctttttttctttctttctttctttctttttttttttttaacaacctctttgccatgactgaaaagaagcctgtatatcctgcagtttctgggcattgtgagtctccttttaaactcaaattggtgataatggtgactgtgactccctattgtccaaggaggggagttgcagatagggccttcaaagatgatccaataaaaatcagtgcagtaagactttttgataaaatgatctttatgatgtagaggcatttggaatatgggttgggtactggataccctggggctaagcccagtgtttaaaaatcaaggcttactacgaaaaggtctgtttttattagtgcaggtactgtagttggcaagatttcttcttatgaaatgcaatatccagcagaccattcctgattatgttatgtatttttagatgttaccattgagttatatttatagtatagactactgaatcttatcttaaatatgcaaaatatatgcataactaacctcccaagctgcgttccctgctctatattacacccaacaatgtagcctgttcttaaatggttctcctaaaagtcttagaatggagcttattatttgcttttaaaatgtaagcacagagactgtgtgttagatgtgtggccttctgggtgacatgttctgctcctagatactctaagggtgaagtcagcaaacctttggcagtgcaggtggggagtgaaaccaatagtcttgcatagataactccccagagtccagaatgagccaaaagtaattgatatgccagtctttgccagcatgtttggtgaatcagagcagcaggtgtctgttacggtattggggaaggttaaatcaccgactgcattgctgatgtggctcttgcttgtgcccatcagcttcccagtccccagaacccccagagtcctagactctcatcattctattcctcaggacaacataaatattatcaggagcactgtgagcacagtcctgcttctgctacttaaagttgaagggaaacgagtatccttacatctctgtatcccatgttcccctgtcttcatgaataagtggtttgattgttttgaggccaacttgagtttatagagcttgtctaataaaaagatggatgtccttggggaaaaaaagctgaggctaataaggtgagagagaaacggaatcctttcaatgagctaagaaattacttcaattgaaaagcctgggaagtgaccctatcttggtcaacatatttcatgggcaaggtctggggatgtctggtgtcttcccaacccatgaaggcacccatcccacctgggtttgccctttctagatggtggcccatctcaaggatatttttctttctttctctgatccaaatccaaggactatgttctagtccttcagaaatctatactaacaaactggataagtgattctgcctcaaagttgcataactacagaatcattggtcaagttcttactgcctgctcacttattcatcaggaacttattgtgtacctgccatgtatcaggtactctactaggtgtgggggttacaaagatgaatgtagtgcagtccctgaactgaagaacatagtctcatcatggatgaaagtactccactaacataagatacattattattgtctaacatatgtgatgttattatgggtatggtacaagatacagtggaaacagagatgagaaagctgatcttttacttggagtggttggctaagaattctcatttcagtatggctttaaagaattcaagatacggctgggtgtggtggctcacacctgtaatcccagcactttgtgaggctgaggcaggacgatagggataaattgtttctataaaaaaagtaaaaatgttaggtgggcgtggtggcacacgcctgtagtcccagctactcaggaggctaaggtgggaggatcacttgagcctcggaggttgaagctgcagtgagctgtgatcacgtgagacaaactgataccctatctcaaaaaccaaccaaccagaaaaaccccaagaattcaaggtgggagatgcagaaaaggtaatagtatcctttgcagacagagacacaaaagcatggacacgcgaatgatactgtgcaggaatagtcaggactcatagtcagctgatatgttttagtaaggctccaccagtgcttatacaggtgttcattctgagtagcctgtgcctcggtagtagctaataatgttgaacatcactctaggagtaatcacagattgcctgaaaccataggggttatacatgagggaaagaaggaagaagaaaaagtgggatgaaaggagaccagttatgaaggcacttgaataccaactaaggagctgtgtgtcaccaaattgtagttactgactcattcatttatttatacattccctggaggcagggataccagatagaagactagattaagaatccaatcaagaacaaacaattaattgagctaaggcagtattaattgaaatggaaaggaggattcagataagaaagatatttttaagaggtcagtgttctgactctggtgactgtctatggtaaaagcaagaaacagagaaatgaaatagaatctaaggtttccatattgggtaacagtgtgtcttgtatgtgctcagtaagggttgttgaattgaacacaatgttaagagcggttttctaatgcttttctccaaagttgaaattacagcagaatttcaggttctaaggcatgagagagagagagagagagagagagagagagagagagagagagagagactgaggatctgatgaatctcttggtgttcaacgtgttggcacagtaagcatttcccaccaataaatgatctgtatagtgattgtgataaactgagtttttgaaggatactctatggaggaaccatggttaatgtctcaatttgagaagagaaggacctgcagataagtgtgaatggctgtgtagactgaactgtacattttggcttgccctagccatgagaaagatatatcagatttaaatagacaaggtttttgttacctacatagactataaaagcgttctgcttttttagtagcacactatccaaaataatactaattacccaaaagtggggaaaaaagacaactgtaataagctcagagtatagttaaaaaccaaaatgattattgtgatgttcaaggaacatgaagtctaagtcaaatttgaaagcttctgttgtgagttgatttgtagacttttatggcaaattttggattcattgtatcatgttttgtgactgagtttgatctattcaatggcttgacaggtcctttagtaaagaagacctgtatctcaatgagccattactgaagttgtaatgagtagataggcaatgtcttgatgttcatacagctctgctcaagtggtctgtaattccttgcaatgccgcgaagaaagcactgggctaagagttacaggatcagccctccatttgccagccacatatctgtaaacaaatccctgaacctctttacacctcagatgccttgtttgtaaaatgggaataataacagctgattcggtataacccaaagggctgttgtgaagatcagaagagatactccatgtgcaatttctttgtgacatataaagctctgctgacttgtgatgctattactattgagaaggccacataggtggaatggttaaaggacctatggaagaccactacgtatgatgttaaggacagtaataggctgggacagtgaaatgtggtagtgccctctcttttttctggctgcatgggtaagctgagactgcaggatgtcactgtcttgagttgttgctccgtgctacatctgaatatattacagtagtaacgtactttcagagagctgacaaaattgtagtcagagatgatctttttgaagcaaaggactcttagtcttttattgtggatttatgtagctcaagggatatagttaagaaccaaaataaccattcctggatcttaagagacaaaggattcatagcagcagttgtttttgctgcacttgtgtttatctccttaaatgtgcacgaatatgtatatgttttttacagcatggggaaactcatgttaaaattcattgaaaccattaattggaagcagatatacttctattacatgttttgataatctgtatttacaaacaatttgtattatttttctattcttttttgttatctacctacctgaaggcgagtttcctattatttctagttcaggcttataagaatgactaatatatgaggggaacttctaaacagtctattactctgcagcccatttggataaagaagtgtgggaagatttgagaataagttccctattgtcatcaacacatgttgaccactgacccttctttcttttccaggcaacttaaagtggtcttaatttgtataaaattatatatcaattttgtccctaaaaggtgtggatcaggctgctaatctgattttgtgggtgtgaggagagggaagcatatatagcctatgatgtatgaatacatgtgatgtgcacatatgtacagcagatccatatccctgaaacattttaggagaactccttaaatgaccatattctacttgtgcagctgtggcagtaatgataactttggtttaatatggattattggaaatggaaatgcaataaatggaaactagtgtatatcaatatagaaatgcctattcattttcattaaaagagtattcagataacattttcataaatgttagaccaatgtgtcatgtggaggcagttattaaaaagactgaaggcaaggggagttgtttaactttaaaaaagacttgatatttgtaagtcaaatttatatttccatcccagatttactctgcaactcaggtttggagctgtgaagtcaaaacccaactattacatgcccagccacaaatcagcatgtcatggagagttgttgtgtgtgtttttgtggaaataagtgggagaagttaactgctgttgaattgttggaaattattggttaaatttgagttatatttgcaaatacacaagtatcaattgtgcaaagtgacgttaaagatgaaaaagattttttaaaaatcacactaactatgcccttgatggaagttacctttcagagctgcttcacttacattctctaaaggtttcctgttgctttctattcgttattcttaatttaaaatcaaattgtgccattgagaatcaagaatgtatcaagagcatttacaaaatgtttcagactacaatgtaaaaaagtaagaatgactaaatcttgaagctcacacttgtcaatttaggatagtctataaattcaaattcaagtaaatttaacttttattttatttacttttaattatgaagcagatagcatctcagttttctcacctattaggtccagggtgagaggagagagttacaagttatctattagcatggttcttatgaaagtaatatcagatatggtggcatgtctaaaagcactttgtaactataaagaacagtgtgagcaatgtttgtatttattattattattatttttgacacagagatttgcttttgttgcccaggctggagtggagtggcactatcttggcccactgcaacctctgcctcccgggttcaagtgattctcctgcttcagcctcctgaatagctgggattacaggcgcccaccaccatgcctggctaattttttgtatttttagtagagatggggtttcacaatcttggccaggctggtctcaaactcctgacctcaagtgatgcacccaccttggtctcccaaagggtgatattattattatagtaaatatcacattgaacaatttttatctaaaactaatgtcagaatgtccatttcttgatataaaaataaaaaagtttgcttttcatttttatctttctgtagagatgttgctttctcattgacacagaaatcaagactgttcagatgatgttaataaaacagcacatcaatataatttttgaaggagatttataaaaatgtacattttaattgtcattaaatcttaatacttattgagcaccaaggatgtgatgagaagtagcctgctaggtctaatgacactacttagctgtttgaataactaaatagcacatttctatttagagaccatataagtattataggtattcttggtgatgttataaagttcttcaaagaaaatatgtatttatatctggctttatatattggggcaaaaatagcaataacactttcaaaatagtgacggaaaaacgagtcacaataaatacgttggattctgaagataaaggagtatataattctcagagttacaacatctgtctataaaaatagtgcaattgggatatactattttagtaagaaactcattaagtgtaattttaaaagctgctgcttttttcttaagtttgacattccagtaaactcttaggaaaatgtccttccagttgcttttcctctaagtgtctagaagtggaagtacattaaaattaaaagcagaaagtcccttaaattccttttaagaagtccatcctgttagtctgactcctagaaaggctatggttgctattactttgggctggaacaagattacaaaagacctcaagaagaagtggaaattatcatgggagttttctgtcactcttatagtttatggcctttttgttctttttttagtccattaaacatttctttttgccaagaggtcctatctgtaaaaggaagtctttgataatgatagtttaaaatgctatgtaatgagatacttatatgcaaaaatccaaaaaagcttttttatttctataataatgataatagcaaacaaattatagtgaacagtaaacaataagctaattataattatgtgaattgctttctccctcactgattccttctatacctattattttatttctctgttcacaatattcctgtgctataagggagactgctaaatttgctcttttttagatgaagacttagagacctgtaaggttgatatgactgcctcaaagacacatggtcgcgctgtggctgagtcgacactcaaggccagttctctgtgtttctttttcagtgtgacttgatatagcttgtatcttaaacactgcatttttcttatgttctaggtttctcctctgccaacccctcctggaccattgtcagcagttgaacgacaaaggctgtgaatctgcatcctagtcttagcagtccctctgattctcatgatgagctcacctgcacagcctggtcagtctggttgcttcttaaactgttaatagacttcatgtgaaagatgttgctttgtgttgtttcaaaccaagtaatttaatttatgaaggaacttttttttttttggacaaagattgcttaatgtaacaaattttgaattttgcattcgatagctaattctctattgcttaacccagtttgcttcctggacaactgatttgatttgcattgtagtctgagcatgggactttaattcttctgcttccaaggtaacattcagattgaactttatgaagttatgaatatgaactattatataggaatccatttttcacctgtaatctttctgtcctaacatgtgtctgtatgcttttaaattatactgtggggctttggaagtcagtttgtggattgactccacctccatctctttgacacacaggaaggatatttttcctccccacccttctttgctgccattcctgtttcctatatacatatttaattataatctcagcacctgcttcctcctattccagtgatgtgtgctgctcatgtagtgctgtgatcagcacagccaacacccgttcctccaggaacaggctgtcatttttggagcaaacacaatccaagttttgggaatgatgaagtagggtcagataccacatactagtaacagacaagttttacaagaattttctgcttggatacttacagaagcatttatttctttatagattccttagcatattgatatccttggtttattgaactaagttgaagcttatgtactatcatactcagggcttataagggagacaacttgccaagattttcattccctggattgccacacccaagttagctgtttgggaattccgctgtttcatcaacctttccccacatccccaacaggcctccaacttgtatgctgaatttggaacttgattctaaatggtgcagtccagaaatccctgagtctttagtcacaaccatgtttgataattggcatgtcactaggttaggcagatggcagttacttacttatgcctgttagctctgagtctttattgcctagtggttctcaaactttagcatgcattgacatcactcggagagtttgttaaaacaagccctattctcatagtttttgatttcgtaagtctagagtggggcacaggaattgtgatttttacaagttcccttgacaatgctgttgctgcttggggaccacactttgggaatcactggtttagcttcttctgcccatttctcaccccatcccctaccagcctctacagacaaccttgtttaagtgtgttctgtgagcggcattgcttattacaattatagtctagtactattattctttctgttgggatgaacttaaattaacatttaccttatataggtgtatattgcattttaaatattatgtatatttatttgtatataaattcagtgtttcaaaattggattgtttaaaagaggcattaatttagaaccactgtggtcaagtatttttttcttgtgataatatttggcagtggatgttggtctaccctgctccccaagaatgttgattttataaaatgaaaatctcacttgaagctgctattttgatgaggaaattcttgcgagttgtgataattgttcagttatgaggagagaaaaggtgatggataaataagacaaccattgaatgaagctcacttgactttagggtcaccaaaatttcctcgtgtacttttttcttataaatcattctgctgtgttgacaataacattatgcagaagtctcaatcaactccatttgggaagtttttatgaatgaaatctgaagttgaggaaagtgatagtaaatgtgccaggtgggtaggagtttcttctatttattgcaagtaaaaaaccatgatcagagacctgaaattcactttgcatggataaaggaaaatgttcctgccacaaacataaaaaaaaattttctcctgttattagcctgcatcttagggtgccgtatatattctgagaaataacctgattgtttgatttagaaaaaaatatgtttttcttacatcttttttccccactatctaaaaagagaattaaattggtcttatgcaatcatcatccatttattttgcttttgttccacaaatggctctaaggagttattgtgcaccagaaagaaaaatagactcacttcagtagttccagaaattctttaatagtccatgtttcagactgagtatgtttgtcttcaaaattggttctggtatagtgtgaattcttatttttcccatacattaacatcattcttagaaacgttctccatccatattcaaatatggttgatatgaaatacaaaatgccgccgtcttaatcatgcattcagtcaaacaataagtgctgatttttgtatataaaatttactagtttttattttaattttgctgcccagttctgttcaaagttagagccttgggtattgcttttgggcactgaggatcctgaatggaggaaagactatctggataagattggcagctagctgctgcagttgagctcttcattcaaaacttattaagcatctaacttgtgccagccagtgtgttacccaatagggacacaacaagcactaaaacatagtttctatccttagggacagcaccctttcatgggagagacaaatagtaatagctttagtccatttagtgtcttaagtattttaataaatttaggaccagaaatttatttcctctgtacagcagtatggatactatttctagtaatgtaatttttatcagaattgccaaatctcagaaggaaggattttaggacttatctagcattttcaaaacatgtcagatagtaaaaatctcctgagacttgttaaaaatacagatttccagactcctccctgaaagagtatcgtgtggtagcctgggggaaggatactggattgtagaatgtatattgctctttgctatgacttggcaaagtgtagaaatgctcttagtccattcaacagcactagtgtttcatatttggagactataaacacaaaaacacatcataaagtcttatctcaagtaaatgtttctcttgtgagcaaaactatgctaattcagttattttgttctctgatgatagataaataaaaagctaacactggctaggtgcagtggctcatgcctgtaatcccagcagtttgagaggcctaggtgggaagattgcttgagccccggggttcgagactagcctgggcaatatggtgagatcctatctctacaaaaaattttttaaaaaattgcttggcatggtggtgcatgcctgtagtccctgctacttaggaagctgaggtgggaggattgctcgagcccaggaggtcaaggctgcagtgagtgagccatgatgaagccactgcactgcattctagcctgggccacagagcaagaccctgtctcaaaaaaaaaaaaaaagaaagaaagaaagctaacacagtggaaacctagagaaggcaataatttgaggggaacattctagtggctttgcgtctatctaggccatctcatttttatggggaggtggatggaccaaagagatttttatggagtgcctttattttcctcaaaagaagtttaagcatattttaacccagggcagctttttagtccgatctcaagattatagaaaacctaatttcagcctgaacgtttttaaataaattgggctacatcaaccctaacatgatttttaaatttgatgaatctattttttgtaattaattttgatgaaaacgcatccaaaggaattttccaagcatagaacacaatgtgcctgttgcccttagaattgtgcaatgctctggccttgtgggcttctaggtaaagtggccaaagctgtgttgcaaagtcctgtaacattagttttcaaagccccttgtataaagctagctcatctctcttttcaccattgtgggaagtactctactcatatgaagtgagaggaccaagctatttatagaagtgaaaggtttatagcaagatcttatattctgttcattttctcgtattctattcattttcttattggcaagtcttgggcaaaaattaattaagagatttatcttcatgcctctgttttgctaaacagctgaattcccccatagaaatgtagagtacatgtaactaatgatcaaaaagttctttgaaatataaattgttatggaaatgctaagtagtataaacaatttgggggcaagcattaataaaagcttctctgcaagcatttttaaagaggactaataaaagcttcatggttcaattaatacagcacaacatcaggttttttagaagcatatgggacccagaaggcctgcccctgtttttaaaatttacgaactctttaatgattcaccatttttactccagtgcattacccacagtggtgccatttagccattaagtaggaaactaaaaccaggacaaagctacaaacaaatatcataatgtccaagtgggtattttttcttcagtttgttcatagtgtgttaccaaaaaaatgaatgttaaatgaaacagagtcttagggcaaatcaaataggttatggcttccctagatgagtatgatcagttagctttttaatgaaatacaggtcaaatcccatgacaagtagctctacataactaaaatattttcaggccactggccaattatctatttcaagtaatattcaagaaaattattccaggataataaaacaaattagttttttgatgtttgttgtagcagaagttgatcacagggtatggtattaatgggaaacactgtatgttaaagttattaactattgttttggatttttttttttttttactactttaacttcacagttaagtgattcattcttttgccatttgtaagtcaaaacttctcaatctgatattcaagtttgaaacataaaccaaatgaagcattttattcattctctagtttttgaaggacagtgctttaataagtgaggcataaaccttttctgaaaatgttcagtataaatttgttttgaacatttatttgtttttatatttgcttttcacaattaattttggtgggtaattcaacttatataattttcattattgtaacactacaaacaaactccataatgcaggccaaacagaaaaggttatttctcgttcatataaagactgagtagagagctgctgtttttctaatggctaccctttgccccggacagcttctaactggtttgtgcttcttcagttcatgtattctaaggtcattgtgcatctccgcatcaagctggtgggagggaaattgaagaggtgcattgagtgtgagaggtttccaaaggtacatcacttttgttcacatttcgttgagtggaatttagccacgtggccatacctaactacaaaggaggctgggaaaagtagtctagcagtactccaggaagaggaggagacaggtttggtgaacagctggcctctctctaccacatttgtcttaaaattttatacctaggactgcagatacggtattgcttaccaagaggtgcagtattttataatgcactcttgatttaaccagtcattaaaaagttaagtaattttcctttgaagagattgaaacacattaaaatcagggcagatcagctcaccaacatttctaagagttgcctaagcctttgtttatgaatcatgcagaatagataatgcccagtgtagctattagaaaattcaagttcctgttagtgggaactctgcagaaaatgggagtaaaatgtatgctgaatattatatgtccttaattagtgtttaaaaataatgtcaatttatctgaaattataattgcacatatgctgaggaaaaagtactttaaactttataatcacaattcttatgtttgttctttattgcattttggggtcacgtttttcaacacctctgtagttttaagtattatgatgaaaatctaggccaaatatacagtggttgataaatacttgttttacactgatcttttcatgaacactactataaaacaatgctagactatatattttcttaagccctgtaagcaaaatcttgctacctctgcaaatacacatgtacagccctttgtttataacattatgtggaacctttatggaggatttttttgtctgtatagattggagtttactcttcagagtacaaaaactctgtgtgtgtgtctgtgtgtgtgtgtgtacgtgtgtggtgcatgtgtgcttgtgttgcagtactataataactctagggaaacacaaaggtatgtggaaccatgtaacctgtacttttacactaaatatcccccaaggctttactttctgtggttttctgcatatttcttaatttttgtcatattttgagaatgtcaacgtatagcagttttctccatttataattcactgcctctaacttgttgtagggttagaaagctaagaattgtgttaaataaaattgttaaaagatcacaagttctgaggaggtgcaaatgtcttgtttttttttttttttttttgtgtgtgtgtgtgtgtgtgtgtgtgtgtgcgcgcatgtgtctctgtgtgtgtgttttaaatagagttttgttcttgttgcccaggctggagtgcaatggcatgatcttggctcactgcaacctccgcctcttgggttcaagcaattcttctgcctcagtctcccaagtaactgggattacaggcatgtggcaccatgcctggcaaattttttgtatttagtagagatggggtttcaccatgttgctcaggctggttttgaactcctgacctcaggtgatccacccacctcggcctcccaaagtgctgggattacaggtatgtgccactgcacccagcctgcaaaagtattttttatgaacaaaatagaagtacttgtttttcttacatactgtaattgcattttaattgtctccttatccactgcacccctcttattttctcggttcttctgtctttagtctatagatttacagaattttgagtttccagcgggtgaggcatcgttatggttttaattttgccatacttttccttgcagttatgatacatcagtttttttttctttttttttaaattatactttaagttgtagggtacatgtgcacaacgtacatgtttgttaacataggtatacatgtgccacgttggtttgctgcacccattaactcatcatttacattagatatttctcctaatgctatccctccccctgtcccccaccgcacgacaggccccggtgtgtgatgttccccgccctatgtccaagtgttcttattgttcagttcccacctatgagtgagaacatgtggtgtttggttttctgtccttgtgatagtttgctgagaatgatggtttccagctgtatccatatccatgcaaaggacatgaactcatcctttttatggctgcatagtattccatggtgtatatttgccacattttcttaatccagtctatcattgatggacatttagattggttccaagtctttgctattgcgaatagtgccgcaataaacatacatgtgcatgtgtctttatagcagcatgatttataatcctttgggtatatactcagtaatgggattgctgggtcaaatggtacttctagttctagatccttgaggaattgccacactgtcttccacaatggttgaactagtttgcactcccaccaacagtgtaaaagtgttcctatttctccacatcctctccagcatttgttgtttcctgactctttaatgattgccattctaactggtgtgagatggtatctcattgtggttttgatttgcatttctctgatgaccagtgatgatgagcattttttcgtgtgtctattggcttcataaaagtcttcttttgagaagtgtctgttcatatcctttgcacactttttgatgggctgggttgttttttttcttgtaaatgtgtttaaattctttgtagatttgtcagacggatagattgcaaattttctcccattctgtaggttgcctgttcactctgataatagtttcttttgctgtgcagaagctcttcagtttaatgagatcccatttgtctattttggcttttgttgttgttgctttcggtgttttagtcatgaagtccttgcccatgcctatgtcctgaatggtattgcctaggttttcttctagggttttttttatggttttaggtctaacatttaagtctttaatccatcttgaattaatttttatataaggtgtaaggaagggatccagtttcagctttctacatatggctagccagttttcccagcaccatttattaaacagggtatcctttcccatttcttgtttttgtcagatttgtcaaagatcagatggttgtagatgtgtggtgttatttctgaagcatctgttctgttccattgttctatatctctgttttggtaccagaaccatgctgttttggttactgttggcttgtagtatagtttgaagtcaggtagcgtgatgcctccagctttgttcttttggcttaggattgtcttggcaatgcgggctcttttttggttccatacgaactttaaagtagtttcttccaattctgtgaagaaagtcattggtagcttgatggggatggcattgagtgtataaattaccttgggcagtatagctatttccaagatattgattcttcctatccatgagcatggaatattcttccatttgtttgtatcctcttttatttcattgagcagtggtttgtagttctccttgaagaggtcctcacatcccttgtaagttgcattcctaggtattttattctctttgaagcaattgtgaatgggagttcactcatgacttgactctctgtttgtctgttattggtgtataggaatgctggtgatttttgcccattgattttgtatcctgagactttgctgaagttgcttatcagcttaaggagattttgggctgagatgatggggttttctaaatatacaatcatgtcatctgcaaacagggacaatttgacttcctcttttcctaattgaataccctttatttctttctcttgcctgattgcgctggccagaacttccaacagtatgttgaataggagtggtgagagagggcatccctgtcttgtgccagttttcaaagggaatgcttccagtttttgcccattcagtatgatattggctgtgggtttgtcataaataggccttattattttgagatatgttccatcgatacctagtttattgagaatttttagcatgaagggctgttgaattttgtctaaggccttttctgcatctattgagataatcatttaatttttgtcattggttctgtttatgtgatggattatgtttattgatttccgtatgttgaaccagccttgcatcccagggatgaagccaacttgttcgtggtggataagcattttgatgtgctgctggatttggtttgccagtattttgttgaggacttttgcatcgatgttcatcagggatattggtctaaaattctctttttgttgcgtctctgacaggctttggtatcaggatgatgctggccttataaaatgagttagggaggattccttgtttttctattgatgggaatagtttcagaaggaatggtaccagttcctctttgtacttctggtagaattcggctgtgaattcgtctggttctggactttttttggttggtaggctgttaattattgcttcaatttcagagcctgttattggtctattcagaggttcaacttcttccttgtttagtcttgggagggtgtatgtgtctaggaatttatccatttcttttagattttctagtttatttgcatagcggtttttatagtattctattctctgatggtagtttgtatttccgtgggatcggtggtgatatccccttaatcatttttgattgcgtctatttgattcttctctctttccttctttattagtcttgctagcagtctaccaattttgttgatcttttcaaaaaaccagctcctggattcattgatttttttgaagggttttttatgtctctatctccttcagttctgctctgatcttagttatttcttgccttctgctaccttttcaatttgtttgctcttgcttctctagttcgtttaactgtgatgttacggtgttgattttagatctttcttgctttcttttgtgggcatttagtgttataaatttccctctacacactgctttaaatgtgtcccagagattctggtacattgtgtctttgttctcactggtttcaaagaacatctttatttctgccttcattttgttatttacccagtagtcattcaggagcaggttgttcagtttccctgtagttgtgcagttttgagtgagtttcttaatcctgagttctaatttgattgcactgtggtctgagagacagtttgttataatttctcttcttttacatttgctgaggagtgctttacttccaactgtgtggtcagttttggagtaagtgcgatgtggtgttgagaagaatgtatattctgttgatttggggtggagagttctctagctgtctattaggtctgcttggtgcagagctgagttcaagtcctggatatccttgttaactttctgtctcgttgatctgtctaatattaacagtggggtgttaaagtctcccattattattgtgagggagtccaagtctctttgtaggtctctaaggacttgctttatgaatctgggtgctcctctattgggtgcatttatatttagtatggttagctcttcttgttgaattgatccctttaccattatgtaatggcctgctttgtctcttttgatctttgttggtttaaagtctgttttatcagagactaggattgcaacccctgttttctttttgctttccatttgcttggtagatcttcctccatccctttattttgagcctatgtgtgtctctgcacgtcagatgggtctcctgaatacatcacactgatgggtcttgactctttatccaatttgccagtgtgtgtcttttaattggggcatttagcccatttacatttaaggttaatattgttatgtgtgtatttgatcctgtcattatgatgttagctggttattttgccagttagttgatgcagtttcttcctagcattgacggtctttacaatttggcatgtttttgcagtggctggtaccggtttttcctttccgtgtttagtgcttccttcaggagctcttgtaaggtaggccaggtggtgacagaatctctcagcatttgcttgtctgtaaaggattttatttctccttcacttagtttggctggatatgaaattctgggttgaaaattcttttctttaagaatgttgaattttggcccccactctcttctggcttgtagggtttctgtagagagatcagctgttagtctgatgggcttcccttcgtgagtgatctgacctttctttctggctgcccttaacagtttttccttcgtttcaaccttggtgaatctgacaattatgtgtcttgggtttgctcttctcgaggaggagtatctttgtgatgttctccgtatttcctgaatttgaatgttggcctgtcttgttagtttggggaagttctcctcgataatatcctgaagagtgttttccaactcatttccattctccccatcactttcaggtacaccaatcagatgtagatttggtcttttcgcatagtcccatatttcttggaggctttgtttgtttctttttactctttttttctgtaaatttgtcttgttgctttatttcattaatttgatcttcaatcactgataccttttcttccacttgatcgaatcggctattgaagcttgtgcatgcgtcatgtagttctcattccatggttttcagctccatcaggtcatttaaggtcttctctacactgtttattctagtgagccatttgtctaatcttttttcatggtttttagcttccttgcgatgggttcgaacatcctcctttagcttggagaagtttgttattactgaccttctgaagcctgcttctgtcagctcatcaaagtcattctccgtccagctttgttccattgctggcgaggagctgcgatcctttggaggagaagaggtgctctggattttagaattttcaacttttctgctctggtttctccctatctttgtggttttatctacctttggtctttgatgttggtgacctacagatgggattttggtgtagatgtcctttctgttgatgttgatgctattcctttctgtttgttagttttccttctaacaatcaggaccctcagctgcaggtctgttggaggttgctggaggtcctctccagacgccgtttgcctgggtatcaccagtggaggctgcagaacagcaaatattgctgcctgatccttcctctggaaacttcatcccagatgggcacctgcctgtatgaggtgtcattctgcccctgctgggagatgtctcccagttaggctacatggcggccagggacccacttgaggaggcagtctgtccgttctccaatctcaaacaccatgctgggagaactactgctctcttcaggcctgtcagaaggggacgtttaagtctgcagaagtttctattgctttttgttcagctataccctgcccctagaggtggagtctacagaggcagcgggccttgctgagctgtggtgggctccacctaattctagcttcctgagcactttgtttatctactcaagcgtcagcagtggcggacacccctcccccctgccaggctgctgccttgcaggtccatctcagattgccacgctagcagtgagcaaggttctgtgggtgtgggacctgccaagccaggagtgggatataatcttttggtgtgccatttgctaagactattggaaaaacgcagtatttggttgggtggtgtcccgtttttccaggtaccatctgtcatggcttcccttggctaggaaagggaattccccaactccttgcacttcccaggtgaggtgatgccctgccctgcttcagctcaccctccatgggctgtaccctctgtccaaccagtcccagtgaggtgaaccaggcatctcagttggaaatgcagaaatctcctgtcttctgtgttgatcacgatgggagctgcagactggagctgttcctatttggccatcttggaacggaccagtccatagttttataatgcatgcctatgtgttgatttgtgttgctttggagttgctttaatatccaaatgaaagactcatgaccatattattggtgaacttttaaaaaatattgtattgatttataggaaattgataagctttgaggtaatctgtaaaattatttttaacccccccccccctttttttagaataacttcctggcacttgattatataaggctcttgctgcttatgatagatggttgctcctcacatatcattgcataattaaccttttctcccaggctcttaatgtccaagaaaatgttctcttcataccagtaatgtagttccactggaaagtgttctgggtgagctggggatttttcctttggagctggaatttgccctagtaattctgccttctttggaattctgtgagttctgtgagagggcagataatcatagtggtgtatgaccaagcactcaccttttatctttaactctcagaagaaattgtttttcagaaagaaatgtcaaaatgacattattcatgagaaaaactagtcatgagttttggactctctaggaatgtaaacatgtttaataaaagctggtgacagtttttcggtctgctgttactggaaagcctgcttgatttccttccctgtgtttttctggtcttgagatctccagtgctttctgaagatccaggaatgccgtacaaatgggaaaagccagactgttatcttgaacctctgtttttgaaatctctgtctgataaggaaaaaaatattgcaagtcattgtagttacttgtttggtttgtcactggaattccaaatatttgcttggtggttcatggacatgtaaattttgggatatgttactattgtttagggtatactgtctgtaaaataagttattaacccagtgactgttaactagatcttccaaaagccctgtctcctatcattttatgtgtattgaaaaattattataattagagatttttttaaactcttagaaaatgaaagtatacagctatgaaaattctgtttgggtaattttttaaaaaatttattttcagttcagaggtacatgtgcagatttgttatacaggtaaactgtgtgtcacagggctttggtgtacagattatttcatcatgtttggataatttttatgttattttttaatgcatttttatccttttgtctgtattattgtgcttccttttttattaaagaagagttggatgtatcttactttggctttatgtttaaagtgaaacagtaaattgaaagattttaacaggtcgtggtatgtcaatgaaagaacctagaaattagcagaaaaatgcaggaagccaactatagatattggaaaaataatacataccataacttgagttaggtaatgtacactatcgagtctttgaatttcaataaagtatgtcaaagtagacattgtatgtcattttcccttctgttgggagaactgataatccgcctacccatctgccttcctacctttcttagttttctttctttttcttttattctgcctaagtccagaaaagatttggggtctatataagtaagttatggaaaataaaatacgtgaggaggaagggaaatgaagggaaattgggtacaccctgttagtacctgcatttaaattctgtgaagttgcttgaagacggatggatctgtgtctgagcttcctgattagcaagtctgttgtctatggtgcgattaatctcttctcagcctaactctgatatagtcactgccctgtataagaaatgtcagtggctctctatcacatctatttaaggtatataagaacccgtacccttttcaggcttatcttatttttctcctcaatgaaccccactctgttcaacatgtagagctgcttaccttccccaggtccagttttcttgcttggaggcctttgaatgacccttcctcaccactgggagtgtcctgtttacttatcttcaacacccagctcctactccattcttctgtgaggccttcctgggtgacgctgacatttgttacctctctcagttctggaacttaccttagtactggggttgtcttctctaataggcttagctttttgagggcaagggacatctaagtacattttgtggggtgtatatagagtgaagcagttggcagctgtatttatggttgctctcttagttaagtaatatactgcccagcacacaaaaggagccaaataagtgaagaataaagggcactttgtgaggaggctgattatagtggtgctaggggcatggaattggggaggagggaagcagttgaatatacctgagcaaaaccaaactgtttcatatgtgtcatgaatcatatcccttttctttttgcttattcatttgttgactttcggttcttttcacctctagtgctatccactgaacttcctccatccccctacctccccttccctcccgttccctcctccacctcccctcccctcccctctcctctttgacagagtcttgctctgtcacccaggctggagtgcagtggcacaatcttggcttactggaacctccacctccctagttcaagcaattcccttgcctcagcatcccgagtagctgggattacaggcacatgccaccatgctggctaattgttttgtatttttagtagagacagggtttcactatgttggccagacttgtctcgaacttctgacctcaggcaatctgcatgccttgggctcccaaagtgctgggatgacaggcgtgagccactgcacccggcccccctctttctaaggtggcttatctattcattgaacaacaaacattgcaatagggtagtcattgtttgcaagacttgtggtttcatactgagttctctaaatgtggggaagttgctaagtttggctcttcttcagctagcacagcggtagaagcagacctaccaccctctttccttttagtaacttgaacttctccctgtttcaatgcttataaaccacctctctcccaaaacaaatatgtattgtggttaagaatagtggaaagagtgacatgatttttaattgtggttgagcaggaaattgttttaagttagtttagaattcattgatccaacattctttatacttttaaaaagtaatacagttttgcatactgtataattagcagtaacttttaaatatactacgtttctgaggaccttcagtaaaatacatagaaaggaaaacatccggcttaaaatttgtgacttttcaatctgtatacattttcagttcctcttatttaaagtgatagactaataaatattttaatataatggttgaagtctttattaagattaaattaggatcttaaactttctgtgtgtctccattaaagatgtgtttttggcttcattatttgacagtgttgtggtatggcatttaatggagaacaagatctcttactttggaatgtatctggtcaaatggagttcctttcatatttgcccaggaagcttatttttctaaagattatggaaataacagatgtggaacaagcaagcactgcatgtctttcattcagagttctctgaggaaccaccttgggtaggcttttgtttgtcacacacatagcaagtatgtctttaccctgactgatgcaatagtccagcctcctgtggggtatcatccactaacaataatgccataacccattagttgattgcaaactctctgaatccatagggacttgccccagtccaaatgagtgactaattcttaaactacaaggtaaagctgaggtcctaagggaggagggacatgttaaggtttgactgtttattttgcttgttattactgcaggatcattaaagaaatgtttatatcctgttggggttctatgttcttaaccactatataaggatgaataagctttgttttttttgcttctacctctcttatatttctttccattctctaccctccctctcctaaggaaaaatggtgttcacactcattgggtctaaataaacccaaacgtcttttctttgaatattttattaccttatctgtttatctattaatgagaaattatacaaatgcatatttgaagttcttagtaaaagcccaaggacttaaacgcagctctggaaacacctgtcatctatcttttatttagtaaatctccctttgtcccagattcctcatttggaaaatatgtcatgaatttgttatgttggtatcataaaagatgtaattgtacaagagatagtaaagtatcacatgttcatttagaatgatcacacataaatatgtgcttttttctctcaaccgtgacctgtaactatccttttttgaatgtcacaaaaatctcatgtctataagcctctccacactgatgagattgaggcctaaaaccatcatctcccagctctgtcacaatttccagatttgtctctgtctttaggtttgctcacttttgagcacatagaattatgccatccttttcaaattacatgtcagctccttactttatcctacccccagtagtgagcgccttagttgccttgcttcatcttttgatgtgtttttacactgtttgtcatgccagcatttcttgtgagcaccctccccaagacacatacacacacacacacacacacacacacacacacacacacacacacacaccacattcttaacctatggacatttgctgctgtaaattcattatatatggtgcattgaaaatgtttgctctgtgtttctttctggaccttgtgctagcaactttgttttgtcatttttgtcaagtgattttcttttttcttttttttttccaaatcagctaagtcactgataagattgatgagtatgagagattgatcattttacaatttccatcctgcggccatatgagaggttgtatttggtacctagattagatcaaagagtgtcagaactcaatgggctgtataacatgtggcaggtagcagagtaaattggaaagaataagaataccagaaggagccaagaaatacctgttggaaaccccaatctgccctaactaactttgggcctttgagaacaagttactttatctctctggatatcagttttctatcttgtattagtttcctgtggctgctgtaacaaattaccacaaacttggtggcctaaaacaaaggaaatgtattttctcacagttccagaagccagaagtccaaaatcagtttcactgggctgaaatgaaggtgtcagtaggaccttgctccccacaaagactccaggggacaatctgtttcttatctcttctagcatctggtggctgctggcattctttggtttgtgactgtatcactccagtctttgcctttggggtcacattgccttcttttgcgtgtgtgtcaaatctcctcctccttcactcttatatgcatatgtgtgattgtattttgggaccacctggataatctgagataatctccccatctcagaacctttaagcatgtctgggaagtccttttttttccctaagaggtaacattcacaagttctagggataaggatgtgggtatcttttgggaggttgttattcagctactaaacgcctgaaataatatctgaagtcatgctggcttggcttgtaattgctattcatttcattcatttgttcattcaccaaacttttatttcatgcctaatatgtgccagacactgttctaggcaataggaataacccactgatcatgcctttagtaaattcattatattgttggtgagattaccatacagaataaatgctaaaataaaggtaaaagagacaatttagactattggattaattctttgtatgtctccttttgcacagttctggagcacaagccaccagcatgcctcagtacttgtaaatcatttcagtaactacaaggattatgtgtagtgtagcctgtggaccagaaagtattttacagaggtcaaagcacgcatcagcttaaattcaattcaggtgtatatattgagtacaaaaataaagtttagacctccaccacaattatacaatttttgtcaaccctggctgcacatcagcatcaatagcaggcctttacaaactactcatacctgtccccctaccccaccttgtgcttggttctaggtggagcccaggggtcctttaaaaaaatcttattagcagattcttacatgctgagggcattgaacagagagaacctgtggtctgaagaataggaaaaccaaatacaagggtactgatacaaatgcaagtcaaaatactgtaagttttctcaggatatatagaaacaaaatagtttggatactcagaggaaaatgagatcacatctggctcaagggaaatttgaagacggaagtgtttgaaatatccttgatggatgtgtaaaatttcaacaggcattgattaggggagggtggaggaaagggaatccacagaggtctggagtaggggaaaaggtgtgtgtcatggctggcagcagggcccaggagccaagatctaggcaccaattctctctccttttgctgagactttctggcctggaaacttgaagagcttgagaattctaaatttaaatctggtcctctaggtcattgtgaaggtatattttttcaaggcaggagggtaaaatgtattttatttgacaggtaataggttgatatatactttttaaaaatttagaaacatgatttctgggcttccatttgtactcttgctctatgtcgtacaagtattaggagcaggcttctgtgggggaaataaaaatggagaggaatgttttaaagtgtttcaaaagaagaatagccaatatgtgatgactgacgggaaaacagacaaacatagtgggaggtaacaaaggtaatttaaaagttcaagaatgacagtagaattagtgggagtgagacatattgatggaaaagatagctagcatttgttgagtttttctcacaagccaggggctttcactgcattttctttatgtcaatgaattattttcataagccttgaggtaggtactattcttatcccattttacagacgggaaattgagactttgaggggttagttatcttgctctatcaaggtcttacagtaaatctagctcttggatccaggtaccttaattccagagtttgtattgttaaccacagttctgctagttgtcaggagattggcttgagaataaggctgatgaagagtagttgaattcaaagacaggaatttaagaatcatcagaagagaggtcacagtcaaaaacttgggtagtcagcaagcatcaccttatcaattaaaaaacggaagaaagagagaagagtagagggacaagactaaatgtcactgaagctttcagggcagtatcttatacctgtttatggctgccagtcacttaacatatgattttttttttttttttgagacggagtctcactctgttgcccgtgctggagtgcagtggcgcaatctcggctcactgcaagctccgcctcctgggttcacgccattctcctgcctcagcttcccgagtagctgggactacaggtgcctgccaccacacccggctaattttttgtatttttagtagagacggggtttcaccgtgttagccaggatggtcttgatcttctgacctcgtgatccgcccgcctcggcctcccaaagtgctgggattacaggcgtgagccacggcgcccagccatggtttgtttttttaaaaaaagcccttgaatatttaagtaagcaaatgaaccaatccctcaatcgtgaatttttctacctgtgcttcagattctacatacataataattacgatggctagaaggagacaaatctaaagaatttcctcaacttttgctgcctgtttttgtgaccctgattcagtttcaaatccttggggatcttccttggattccattttttcaccttactccatcttttcccccacagaagatagctgcttttggaaggttatcctagcataagaagattggcagaacacttcactacttttgtcattttaaacagtttctttaatttaaatttttcatttttctgtagagatgggggtctcgctatgttgcctaggctgatctcaaaatcttggcctcaagagatcctcctgctttggcctcccaaagtgttgtgattacagacatgggccatcacacctggccattttaaacagtttgtaaactaaggtattaaagtaacaatacataaatggtaaagtatcctgggctgttgagtgtctttctcctcccctcctcttcgagtgccctgaaacttttttcattctaccattctcacaatgagtatgcataaaaagtcactattaaataatccaggaaaataaaactattgcctttaaaatatataaattatacatttttttgttacctgttattgcatgttgagtattcctcatctgacatgcttgggaccagaagtttttagattttgtatttgtttggattttggaatatttgcatataaataatgagctattggccgggcgcggcagctcatgcctgtaatcctagcactttgggaggctgaggcaggcagatcacctgaggttgggtgttcgagacccgcctgaccaacatggagaaaccccgtctctactaaaaatacgaagttagctgagcgttgcggcacatgcctgtaattccagctctacttgggaggctgaggcaggagaattgcttgaacccaggagggtgaggttgcggtgagccaagatctctccatagcactccagcatgggcaacaagagtgaaactccatctcaaataaataaaaaaataaataatgagctatcttggggatgagacccaagtctaaacatgaaattaatttatgtttcatacataccatatgcaaatagcctgaaggtaattttattcaatattttaaataattttgtgcacgaaacaaaatttgtatacctgaggtaaggtgaggaatttccacgtgtggcatcatgttggtgttcaaaaagtttcagattttggaatattttggatttcagattttcaaaataggtatattcaacttatattaaccagatcaaatgttctatgcttgtcttgttctcttgaccctcggattatttcacaatcagaatccagcatattcatttgaaaggtgtagggtattgaataaaaaggatttcagaacagctatatagttgtgtcagatattttaatattatagtactgtatttttgtgctattgtatcagagtcacatttttattaaaatttatgatttacacctaatctcttaaaaaatactgcagagcttgccttagtctgtatcctgcatgtcctatttctttttctagtactgtaattgagttgctatgtaaaatgtggtctgcctatgtaattcttcccacctaactttattaggaaaattaatagaatagcaatatcacaaaagtgtttgattagaatcatgggaaatgaaactaatttgcaataaagcccaagactggctttcaaagcaagtgatttttatggttagaagtcaaacaactttacttacagacagtgatcgaggcaaaaaaagtccatttgttatttgaaagacatcaggaaagccactgattctcagtttggactatacattaaaataacctggagaactaaaaatgaaaaccaaaagtctgaaccaggaccaccacctcaatgatactgacttaatttgacttttatgaggcttaggcgtgagtattcgttaaacctccaaggtaattataatgtgcaactaatgttgaggactgctattaaagcaagcatcaggaaagcacaaagaacaggataaagtaaataaatataaaatccttaccatttaggagatgacatgtcctttctaaaagaggaaatattgtctattaagttatgaaaactaaacttttagttctattttgaaaagagacaaattaatctcatttaaatattgttacaagcatagataagagtacatatctatactttttaaaaagccccttttttttctctttgtatttaaactcacttatcttcttatattcaagattattaaatctcagctatgggcctcgttttcccctaccttcatattgttccaacttatgaattgaaactgtacattaatttccaaatgaataatttaaaatcaatggagtaaatgggacacttgcagtcaatgaaaaaatccagcgattatctcgggcattttttttctccataaagaaagcatgattactcttacaaaatggtattttgtcacttcgtgcaaagtatcttgatcattctgggcctatgttgctttttctgtaaaactgggatatcacatattgctgaattgcagtgaccatttattgagtgttcattgtatttcaggttctaagtgtattaagtactttatatgtgatatctcattttatcagattgaaaacactatggagtaaggactattttctaaaatcctattttgaagatggaaaaccaagccttagagacttgcctagctaggttaacatgtctaaagttatatttcttgttatcgactgggccaggatctgaatttaggcagtccaacacggtagccactggtaacaaggtagcgctaaccctctgtgaagacaaatttttctgtttagctgactggttaagactaaaattaaagcttgtaccttctttacagggacgttttccaaaaagacagtcttgatatttcccaactgagcaacaggtttttctgttgaagctaacaaggaacaggtgcactgctggtgttggcatgtgccgctggcaccggacttgtggtaggatggtgctttctggtgctggttgggttttaaggaaggagcatgacactcaaaaattcccaaagcccataagactctgccccactcttcactaccaaatcttagggaaaacttcgggtagggagaaaatagaagagagctcttctggattaacatgaagtggcttgaggaatgtcaggagtgggaagccaggaaaatttgtggtcagaagaccttaattaaattcctggctctgctcttcatgccctgaaagtcactcaacttttctgaatctcagttttctcaactttaaaatagaaatgatgatgtggtaattgaattccatacttcaaaggacagatgatcaaataagataatgtactgtaaaaactctaaataaagcataaggtggttttgaaaactgttaatgttaataaaagcagatttttattttctaattggaagtctttatctctttaacatgcagaataaaagtaaaacaatatttactctacagaactacttaaattagaatgcctgtgtggtatacttggactgacttttacttccccaaagtgttcaaaacccctaggcatttaagcaactttcagtgtattagttactgcctaatgggcaaaccctatgatcttttctcagtcttcatagaattatagcagtaataatttattattcaataagtgtacattgagtacctactatgtccctggaatgggtttaagtcattggaaataacagtcagtgaaaataaaggcgggcaaaaatgaaattgtctattaagcacctaatgtggacaaagtgttacatataatctcattgaatcttcacagcaatcctgtgacataggttttactggcattacttataaatgaggatactgagggtcagagagtttaagaggcatgtctggcacatcctagcaaggagaaaagtagaactgggattaaaaccctattctatcttcttttctagcaagtggcttttcttgtgaccatttatttgttaattcatttattcatacttcactcagtagtcgtttgactttcttctttctatgaacatcacagatattttcttagccacctgtggttaaaaccatggcaccatctttaaaactcttaactctattcccctccacatcaaatctgttccaatcttgacaaaccttgtcttccatttttgttgccaaccttttgcacttattactccttgctgctactattctactagacttagaactagtctactttccctctcccctccattcagcctaatccatacagtgttgcctagtgaatcttactaaagcacaaatctaattatgtaatttctcgaaaatcttccatggcttgccatggcctacagaaattgtcagtaatcacaaggcattcctactgtcaagggtatagggcaaaccatattttcagccttcttcagtgtgcttcttcctgtgcacaaaattcatgtttcccaggcttgtctgataagaatcacctggggctaaaataattcatagattcagtggtattcccatcaaaataccattgacattcttcacagaattagaaaaaactattttaaatttcatatggaatcaaagaagaccctgtgcagccaagacaatcttaagcaaaaagaacaaagctggaggcatcatgctacctgatttcaaactatactacaagtctacagtaaccaaaacagcatggtactggtaccaagacagacatatagaccaatggagcagaacagaggcctcagaaatagcaccacacatctacaaccatctgatctttgacaaaactgacaaaaacaagcaatgaggaaaggatttcctgttaaataaatggcgttgggaaaactggctagctatatgcagaaaattgaaactggaccccttccttacaccttatacaaaaattaattcaagatggattaaagacttaaatgtaaaacctcacaccataaaaaccctagaagaaaacctaggcagtttcattcaggacgtaggcatgagcaaagacttcatgacaaaaacgccaaaagcaattgcaacaaaagccaaaattgacaaatgggatctaattaaactaaagagcttctgcacagcaaaagaaactatcagagtgaacaggcaacttacagaatgggagaaaatttttgcaatctacccatctgacaaaggtctaatatccagaatttacagggaacttaaacatatttacaagaaaaagacaaccctatcaaaaagtgggcaaaggatatgaacagacgcttctcaaaagaagacgtttacatagccagcgaacatgtgaaaaaatctcaacatcactgatcatcagagaaatgcaaatcaaaaccacaatgagatactatctcatgccagttagaatggcgattattaaaaagtcaggaaacaataagatgctggcgaggctttggagaaataggaatgcttttacactgttggtggggatgaaaattagttcaaccattgtggaagacagtatggcaattcctcaaggatctagaatcagaaataccatttgacccagcaatcccattactgggtatatgcccaaaggaatataaatcattctgctataaagacaaatgtacatgtatgtttattgcagcactatttacaatagcaaagacatggaaccaacccaaatgcccatcaatgatagactggctaaagaaaatgtggtacatatacaccatggaatactgtgcatccataaaaaggaatgagatcatgtcctttgcagggacacggatgaagctggaagccatcatcctcagcaaactaacacaggaacagaaaaccaaacaccgcatgttctcactcgtaagcaggagttgaacattgagaacacatcacacagagaggggaacaacacactccagggcctgttgaggggtggggggtgaggggagggaatttagaggacaggtcaataggtgcagcaaaccaccatggcacatatatacctatgtgacaaacctgcacattctgtacatgtatcctgtttttgtttgtttgtttgtttgttttagaagaaataaagaaaaaaaagaatcacgtggggcttattagtatgtgagttcccagaccccacttgaccatactgagccagaatctgcaaggatttacagagccttgtggggcatggtaagactggtgttcctcccaaagacccagaacacaggtgcatgcctgtgattatcctaggtctcttgctagcactgtgtgttgaggtagtcagccagtgtcatctgatgtgatgacactttgtcatatctgagacctcccagtcaccctttctcacgcattactgaggtgcaaaccaagtgtcaaaaaacccaaagacacattaattaaattgaatcctccaaagaagtgtttttctcacatttttaagagcatgagatatttttatgtgagcacaatgtgaaacacataaaaagatttaacttgtaaataacttgtgtgtggtgtgtgtgtgtgtgtgtgtgtgtgtgtgtacgtttgagacagagttttgctcttgttgcccaggctggagtacagtggcacgatctcagctcactgcaacctctgcctcccgggttcaagcaattcttctgcctcaacctcccaactagctgggattacaggtgcctgccaccatgcctggcaaattattttttgtatttttagtagagatggggtttcaccatgttggccaggctggtctcaaaactcctgacctcagttgtcccaccaatcttaccctcgcaaagtgctgggattacaggcgtgagccaccacgcccggccataaataacttgtttagctcatatgtgattgtccaattttgggcatgtatacatagatacatatacatatataaatgtatataaataaatatgtgtatatgtgtacataaatgattatgggcatatgtatttgtgtgtttgaatatatgtgcttagggatagggacacacatgtacatgcatagatgacttgccttcgccaaaatttatacagatgtttctcaacttacaatggggctatatcctgataaacccattataagtcaaaaaattgtaattataaactggcttataaaaagaccacccaatattgcaagataaaaggcattaactgtaagattatgatgcaagaggaaaataatgaccagaaaataagttggagtggaaaacgtttctctaaaactttctacgctatcattgaaatagctattaaataatatattgaaataaagattgttgcttttctctttttattttcccaattttcactcttattaagtaaaattactcagcttttaaaatcacttgtatcatctcactgtgtatttacagattttttgcttctcagaaatttctgtatgtcccaaattccttttaaatatttaaatattatgcatgttttacctttgtaaactcctacctttgtaaaacatgcggaatattatttatctcatggatttcacccactgtcaaaagtctacttccctatcaccaataaatacttgaatactattaagtgataattttttagaatcacagggatcaaactatagttgacttttgaacaacacagggattaagggtgctatcaccacccccagtggaaaattcatgtgtaactttttgactccctgagaacttaaccattaataccctactgttgactggaagccttactgataacataaaccattgattaacacattattttatgttgtatgtattatatactgtattcttacaataaagtaagctatacaaaaaaattaagaaaatcataaggaaggaaagatatattgccatttattagctgtgtgggtgaagaaaagttacttaacttgactacgctcagtttattcattaaataatctttgcagacctggtaagcactggatgaaataatgtaataagacaaaaatgtgaagattttctccatagtcttatcactctgtatcataatttaatcatgtttctttacacggtttctcaattcctgagagaatgattttagacaaacccagagaactctctttgaatatcattctttgtttcaaatgtatttccttgtggcaggaaacgataaacacacatggcacagacagctagtgactgaaggggaagttaatggtgtttgtttttcctccagaattagtagttcagaaattaaaaataaaaatgtggcttgccaagtttgtaaactacacagaattctttgattacaagatgacaatgaatttaatttttttgacatttgtatttctttgatacttatgaattgaaatgttttgaaaacttatgaatttgcagctttacattttataaactataatgattaaaatatccaaatccattaatttcttccttgccctgtaaacttgaaaactgagaaaagatttagagtaaagcattttgaaatcattgacaagcacaaatactgttagattctatgtcaagattgtattgctgcccttgaggagacattatacgtgctttctaagctatgacgagaagacataaacaaggtctttccccagctatgtgctagaaaaaaacccttaattgtgattgtacagtattgcttgatgcaaaagtcaactcatttttcaccagggattcctgtccattcctggaaatgaggtaggatgaacccggccggggggcgggggggtgtcacagtagaaggtggtggtttaggaaaatctacaagtgacggtaaatactattctagaaagttaatttttttttatttcagggagcaaatcctttatatttggcaggtagaatgcaacttcttggtagtgtctttcatttaattaaaattaagattgatgtggcttgctgctgctgcgtaatatcattctgacttttgcatagctattgcatttgtaaatattcaaatgcactttgttatggataaaagggagttccttgggtagatgtttaacttttattgcaaaacctcttgtgctcacttacgttgccagatttggtagtagtcatgcaccctgggaaaatcactggcaaagcagtggagtggaaaggaatcatgggtatttactgtgaggagaagggaaggtaaaggtgttgtaggggttatatcatttcactcaggaatttgcttttggaaatgtcattaaggatatagtatttggggatggtaggtatttttagaatgtttctaagtaaaatcacgatttttcttttaatgcactgtgaagaaatcatctagtccagtgctcatgaaatcaatttagtaggttgcaattcaacaatggaatagaataggctaaaatacaacatgccagaatgcacacacgttgtaacatttagtgttaatttatgagactgcatgagttttatatagataagcatgtttctatatatatgtgcattgtatttaatatgtatttctcagtatgagtagctgttgaaaaagcttaaaagccactgattgactttttctcccattttacagatgaggaaactgaaagaggctgattctcattttatttgagtgggtctccttgaggcagcttatctgtcatcaggggtctcttgttataatctgtttaattacctatgcatcttttacaatttttcacccttgctcaaaaattgctatatttttgtgaccagaaattggatcaaagatgctgattctggggagataatctttgctgagtctctgagcaccatgttggatgggtagttggtgcttgtaataccaaggggaaaagaacagaatatttatagctctctgtagaggtaagatcttaggtaaagtcagatgaaaaggtggaacaataatctaatacatttcatcaatagatacaacaaatcaccattagcttctaccatttgtttcagttcagttcaacaaatatttattgagctcctacttagtatcaggtattttaaaagctagccacttacttccttctttatgataaattaattagtcaaacaattaaattattctctccctttgcttgtggtgtacagggagatttactgaagtaaaagggggtttcgtttgtcaaagatgaaagagatgtagcgccatgctatataacacaatatgctacttggaaatctgttatgccttatctagaaatgttcctaatatcttgaactccacctttcactcattaggaagtcctgcaatataaagctcacctataatattttctctatatttgctctcataacacattgatttatattgaactttctccttgttgctatttatacagtgtcagttctgctctatgagctgattttttttttctctgactacctgagaattgaggcagcagggccaagggggccgacttgccacgtgaggttttgtctttcccaccttgttaggctgcttctttgcctttctgcctggcaattcctgaaggtggtgttctgttttatctcttttttgtttttaaagtgtttgtgcaaagcatattattctgtttttactttgcttcttaattgagtatcggccatgtaacttattgtttgaagcagttacagcatcagggaatagtcccaaatggcacgatgagcctgatttttcctgatggctgtcactgtggaaagggacacccatgaggtcggtccaagccaaagaaaggagatgtataagtacagcctaatcttattagtgggtctagaaaaactgcttctttattaactgtcagtcttttaaatctttgctaattataacgattaaacatgatattttgtagtcatttctacttgcattcttgattattagtagttttgagcttttttacatatctctgtaggattttcttcccatgtttggaatttctgtttgtgtcctttggttatttttcttttagactattctgttttgttattgatttataagaccttttttctatcctattgaaattaatcattttcattgtggttaaattttatcattttaacatattttgagtgtgcactttagtggcattaagtacattcacaccatttgccaccctcaccgttgtcccatctccagaaatttcccgttatcccaaactgaaaaaaaccatggtaggtgctatgaaaataggcccaagggcctcttcgattcttaacaagagagatgctaaccccttttttcccacaacactagtaacacttcttgaatcatctaatcccctaattatttctctggatccagtgctgccatgatgattgcaacttcattttaaagatgtattcatacattaaataaacaggcaaacagctgttctcatatgaccatcttattgagcaaattctgttttgtttagtctttatagttcttccacttgttatttaatctactggtgtttgatgttttccttgcttgccaatgtggtatttccagctgtgcatggaaattaattttctatttgaatagacaattccaggaaattatctattaaggttataggaggcaaagagaatgttgctttatagttttgtgtgtgtgtgtgtgtgtgtgtggtgttcttggcattataaggaggaaaggttggtttaagagttcatgattgccagtttttgtttttaactaatattacttaaataaaacaaactctgccactggtcacaaacgctgtcaataataggaagtatggggaactgaaaacttattctctatctgaaacaacaattctaaatggattgctcatggactctgaaaccttttttggacaatagacctctttgtgtatctgacagattctgtggaacctcaaaacctaaggttcccatatttttatctaaaaccctagttgagatgcattttggagtcaagaatttatcagattttaaaaaggtagtatgatttaaaaaatgtattgggttttcaaaagtaccatatacccccatattacctatcacctttaatggggtctgggatggttccctataatcaaaaaatagtatttctgcagttaaattcatagatcttaatcttaaatgagataaataaaaacatgaaatagcctcacatctgtgtaggtcagtttatgctgccagataagttgaggtttgttgccaaacaatttctgaaaaatcttttgttctttaggatcagtgataagggacaaacacaatttcacctatactctagggggttccactgttcttggtcaggagtgttttggctccatgcttcagccgggcctgcttctcctcagccctactcaagtcatggacttagcattttcactgttacagacatttttgcttctggagttctgcacctgtcacttttttgatgaatttaatcctcttttttgcagccatatcgtatatgggctctcattctttatactcaatatgtttgccgttatgtataaatgtttcatcataacgtgaacacatatattatgttcatcatcatccctattcctttgtattggttaaaaaattggttattctcaatacttgaaatgccttttttctgtcttcctcctgttaatttatcctctaccccatcattgtaccaggataaccgattttctccttcttttatattctctatattcttttaaagctttgtgtctaccactgttttagcatgcattacattcctccataattatttgaatatttatccatctcttatataagactgcacatttcttgagagtaatacctctttatatatccattgccttgcacagtgcctggcacatacagattcaaagcttttcagcccaagataaatagaaggtgtacatttggagccagtggggtaagattggagacatgagaaagagggatgtacaatcttaataaattagagttcaagacagaatagtgtagaggaacagtgattttgtttagtttatgtgcacatgaggattaggaaattaaatgatatatatggtttggagaatggagaaatttcaaaaaggaggtaaagcttcagacaaacctgggcaaatggatgagattgggatggaataggcaaagaagaatgtacagtgctttcagagaagggagtatgttgaggagcgaattggcattggtggctgaacaagatatttaagctattgccaaactataatggaagttctgaattatgagatgatggaagaaaaaggtcagtaggccaaatggtgctggattatgtaaagcaatatataataagaaaaagaattcgatctattcagagtaaggtgtcattataagttaaggagtagaacagggatggtaagataaaaaacatttctgaaaataaatgtgtccacagcgtacgcagtgatgcctgaactaaaaagggtgtaggggtgtggggctgagttgttttacatcataaggacctgaaccgagaagacagtaatgagactggagaaaagggtgtgaaacttttgaaaagtaaaaccatagtgtgatagttaatttcttgtgtcaactggagtgggctacaggttgcccagatacttggtcaaacactacttagggtgatactgtgagggtgattttagatgaggctgacatttaaatcagtagactgagtagagcagattgccccctttaatggggatgggcctcatgcaattggttgaaggcctgagtagagcaaaaggctgaccccccttatgtaagagagaattctcttgcctgacagtctttaaactgggacattgaccattactggttctgcagtagccttctggcttctgactcaaaactgggaaatcagctctgcagcttttggacttgccagaccccttaatcatgtgagccaattccttataatcagtctccctttctttctctctttctctggagaaccctgactaatacgcgtagtatatggagactgactagatatgggagccacaggagttgagaaaggaattaacaattacttaggaatgggaatggagaaattgaaaagggcagtcaattttgatggaaaatatatttggttttgattttgttgactctgaagtgatattggagattcaagttaaattactgtaagcagctgtagtgaggtaggtagcttgtgtgggtgaggctggatgttgcatctttgaatcatctacaagtagggcaaaagaagttacgtgacagaacagagttcacaggtgaatgagagagacaagcataggcaaggatttgactgaggttcttcaggtgggaattatggggctagaggagaaagatgagccagtgtataaaaatattggtggcagagctctcttgacattggtttgtcagcctcttgcaccagaatgtaagctccatgaggccaacaatttactcagtcctttttccctagctttaagtgttgtacttcagatatttgagatttgtagacattgttttttcttcattttccacttgagacaaagccttttaaggaaaactgaaccaggaattaggatttatttgctgtaatcttgactttgcacttagatatagagactgaggtttgactttttaattcctaggattttgactcctttttcaaaaaatgaggagattggattaagaatttgtaggattccttacaactcaaaagttatggagaaaaatatctataggctgaaaattgttctaagctgcaaaaatggccttgagtaacttcagaaaataaacattaaagcaaatcatcttttatatcccttttttgaatgttttatttatttaatatcaatcaaaatactgtaatagattaaataaatcaaaacacatataatcttgtctagaagcagctttggactaaaaattttcttcgcaaaatattaaaggtgtgacttttaaagaaaatctcttaatacaggacctaaccccattttatatagcattaagttaatataactgtaaaaaagaaaaaaatataagcagcatttttcttttaatatcaacaccatagagaaattttggttcttatggaaattttattctattacaaatcttccaactgtaaaatcttctcttagagttgattatgtaattgaaaacaaagggaagaatcagtggctcaaatggtcctgtgtttaccatacttcattcaaaattctcttgcatctcctcatatgtttctagatatgttaacatcatacaatctcacaatatccatttttaatttatgcaagaatactttctgttttgaatagcacattattctaggttatatccaatgtcagttttgggtatttgatcaatatgtgatggttaaattatagatggctaactttttttcctaattgtacaatttgaaatatggtgaatttccaaaaaatagtttggagaaaatatgaactctattttaaaaatgtgcatgtatgttgatatcatgtatttgacatagaaactgtcaaacagaaatagatgtcataaactttaattcaaaggcattagactactagcactaacaaccaacattttttttttatcaaatagaacttattttgcccccaggatcatgcgttgttttagatattaattaacattataattgtcttctcactttctggtatgcaggggtactctccatgaccaatctttgtcatttatcacctatagtgtaaaatttccatcaggaaacaatcttctgccttgaactaccaaagtgctgattttgctttttgtcattaagttttttgtttgtttgtttgtttgttttaatttgctttagagcttctttattgaggacaactaacagttaagagttttcttggggaatagtgtcacagcaagaatcacacatagacttttcagatacaattcttctatctccaaagtaatgctagaaatattgttgatttacaatagatataatttaaaattatttatttttattttccacagatcccaatttctggatttcttgtgaagtttaataatttatccttggattcattttatttttgtttatatttatatagaaggcatttagccattcatgttgatcagctgacctcttagttccatttgtataatgtaatatctggttatataaacccaaggatctgctgttattgtttgctctgcaatctgatagataagagattaaaatagggtgggtgtagtggctcatgcctgtaatcctaatgctttggtaggccaaggcagaaggattgtttgaggccaggagtttgcgaccagcctgggcaacatagtgcgacctgtctttacaagacataaaaaaattagttgggcgtggtggcatgctgaagtcccaacactctgggaggctgaggcaggagggctgcttgaggtcatggtttcaagaccagcctggacaacatagtgaagtcatgtgtctaccaaaaaaaaaaaaaaaaaaaaaaaaaggctgtgcttagtgttgcacatctgtagtcctaccacgcaggaggctgagatgggagcgaggattgctggagcccaggaatttgaggctgcagtgagctatgatcacaccactgccctccagcttgggggacagagtaagaccttgtctctgaaacaaaaaacagagagagaaaaaaaataataagatgtatgtattcagaaacataaaaaagcaagagtaaaacttttgtgacaactttgttccatttataagtcacactaatgactgatttgcttcttagtaattttccatttgtaacattttgtacctggatacacaaatgtaatgcaattgaacaagaaaacaattatctgtctgctggaaataatgtacttatctcattgaaacaattgacttgtttaaaaatacacaggtctgttcagactgcagttacctgtaatttgtaatgaatttccaggaagaattaaaatcctctgatgtaattgaatcagtagttgaaaacactgattgtgaatgataaatttccatgcataattcccctcttatataaacctccatttggagccattttagatttgagaggttttttcaatattctatgagttttggctggatccctggaaaacttcactcaaaggctgtatcttccagtgaaagcttcatgttgacttgtgggttctgtgtcagtggaacgtttcagtactttttggcctggctcaaatgtttcttggcattttctgtggagtttggcccaaccaatctatagtatcacattggactccagataaaccctaaaagccgtaattcatccgcaagctaatatgggactttattggggtttggtagtagactaacaccatcgagcaattgggagttcaacattatgaatgatatttctaaggacatatctatctgaaaaatcatacaaagagaagctacttttcctttagcccagcacttatttttctcagaggtctctttcacagaggtcaatgtcctattttaattcgttattataattttttccctcctcagcagtttctaaacctattgcagatcaacagctttttcttctttcttaaagtgagatggctctggctcttggctgacttcagtcttgtgatgtgggactgatgtgcgttttcatttttcactttgaaggtgctgccaaagctagttaattttagttataccatcatagaatgctggagcctgtaggtgccctagaaatggtttggtacagcctcctcgttttacacataaggggagccaggcccagttccttagttctcacaggaagctacggcactgttaggatggaactcgtgtccgcctcgcaacagaacgggtctctgcaagtctatccggctgctgaaagatccactccccattcccagtctcagattttgtacctctgggtagttttcctcttttccttaaagctttttaaatgtagctccccatatgttatattaatttgggaaaccagccaacaaattagttttacatttgttaggattctagggtgttatttatgataccattctctttgtgttctgagtcactaagaaataaatataggaacaagacagagatcaaaataatagcttcattataaacagtgttaaattttagaacacatagtggacccaaggtggaagccagcttcttatgcctttaacagtcccctactgagcttagccactcagtcatagagaagtgtgcaactgcaggttcctggtccagccctcatctgcagggcccaccctcagggaggactagctgagcagcacctctgagagactccaggaaccaagggcctcctgccaagggaagggcctctttctcaagtctggccaagtagagcagtccatacccactcatggaaagcagtgtccttcaatggctcaccttctggtgagtgtttctctttccttcttttctcttgctttagcattcctgtttcacactggtattctgaaaccaatattagtatatttcttttccttgtaagatgagttattttcccattattctcctgaatagagttgaaaaagcaaaggtagcaaaatcagcctaggcaactgattatttacaatagagaaaaataaatgaagaattaagtagccggtaatgagagatggcaccatgggaacgtgctcagaatacttcccagtaatggaagatgaataatttttcctgttctctcctgaccaggccattgttctcacatttttaagaagagaaagttgggaaagacttttacctctctgtttacatctttgtttaagctctagacctctgccagcacccaccattgtattttgataaatatattctcagccatctataggtggattcacatgatcttgttttgctttcattttcctgtgattttgaattaagtaaaatttcagatcacagaactctcttggaaattttagttgattcatgtaggtaggtttctataggtttcactatttcattttgttccagatatttttccaatgtttatctctttttttaaatcttctacattagctttcaagatacttacttatgagagcccagataatatttaagttttcttcatattaagggatttttttttccttcagatttcttgccttgtggtgcatgttgcacagacacttgtacttaattcagaggtaaatgaaaagtaatttacaattctaatactcttgatactcatactttctcctttactgtttttatgcttgcaggtttcacttccttttagtaggttgagggccatttagataaaaaagatacagaattgcagactagtagatttaagagtttatgtattatgatttaagttgttaagatttaaggtgttccagtagcatacttggagttgaaatcatgattattaagatgaattctttttgcgtgagcagcttaacagacttctcttgaatcaccataatgtttttgcttcatgggcatgtcaagtatctgttatagtggaacctgagagaggtcatacaggaaatagcatagaagttgtcacagtacacctggaatgatgctcaagtggttgccatgggctcaggagccatttgcctgggttgaaactcagctcttcattcctttgtttcagtttgctcatctgcacaatgggcatactaattaagatatctacctcgaaagttcttgtgaggattaaatggatgaatatatgtaaagcagtttaaacgagtgtctgaacattatatatgctttataaatgtgagctgttaaaacagtccccacgtgcctaattgggtgaatagatcagggttcctctgtgttttcaagtgtttctctcagtacactattatttaggaaaaatagactaaaaagatattgtctgaggtgttactggctgatattttaaaaggtgaaccatgcattaaaagattgtgagtctaaattttgtgtaatttaatattaataaataacctgacttctttgatggtctacgtgaaatatgaggatttcaggcactttgtttccacagccaaaccgtgtatgttgtcttcattactggcaccgattttggcattttgatttttaaattattttgtgcagttttcacagttgctcccattagaggggaagtattgaggaagtagtcttccagttattgacagatcttaagaagcataaaatggtttggtattttggagaaatgtaggataatataagacccagaggcatactattccaagtagaaaatttcatcatataatgcatttatatgtatgtggtatatgtgggtaggcaaattccatcatgaaaggaataatgaaggaacagttttggggcaacctaaagttttactttagtttgtataataattaactcagctgcataaatgccaggaaaataattagaacaacagattatgttgaatgcctaaaaaaatgtgtttaacaacttttaattttctttcctcccacacaccacttcctagtttgtttctggcacaccagttgtgtctcaacacagcggctgatctggtagagttgtgtgaacacctgtgattgtggcagaacaaattttctccttctggttacatttatcgaaagtaaaagtagaaggagcactgtattttggaggtaatgtagagatataggggatagcctaccttttctccaaagctatgtatgagctttcaatgttttgaaagctcatgcatactgaagcgtgtgtccacatggtgaatgtaaacaaacaaaagctgattgtaaccatcttgcttttcctagttagatatcaatgggctactattggtcagagaaacaaagagggacctccattagtggggaaaggtaaaaaaaatttagtgacagtgaaagttttaaaaataatatatattttttctgtttaagatattccattatatttatgacgttatgagattccttcaggagtggttgtttgataatctgtagtttacttaatcattcctatggtgttacagacagatttataaagttttgctattacaaattatggcaccacaaatacctatttgaatctgccttttttttttttttttttggaattatttactcagtttaaaatttctggcctgatgttattaggttaaaggctttgcatatctttgtaagtcaaaggatgtagattttaacaaatggcttttcaagtgctttgccaaattgctttctaatataaatatataaattgttaacaataatgtatgggtttttcagtttcactttttgagaccctgaacagtgatcgttgttgcttttttaaaataattttttgtatttattcaataaatataaagtggaacttcagtgttgtttcagtttgcattgctttggtaaataaaatgcgtgtgtgttctttttttcttcatgtgtctttaataatttaatttcctgttgtgcatgttcatgtttttgaggtatttttcttcttgattttctgtttttctgtcagattgtttatcccctgtatgtaacatacaaatcaacattttatcttatgtttgataaacatatttctgcaatatgttgtttttttattttaccatgactattacttttcttagtgttaaagctcaaactgttgtaaaagttatattattttgtttcttttattgactctaggtttaaaaagttgtcatctttcaaaaaaatattcaattctattttatgctaatgtttagtgaactaatttatatgtgtgtgtgtgtgtttataaacccacggatacatatatgcacaaatacacatagggagttagagacattagtattataatgatagtatatggcatacattttgatccatttttttcctcaaattactagccagttatgtcagcctcattgattacatagctttctgtcttctcctccccagttgttttaaatttcccctttatcatattattacattctaacatataattagatattttactgggctttatttttttattcactgatctatttcaaattagatataaaaatatttttaaaatttaattcttcaaattattaatgcttgataatatgctttaaatgtagtaggttcaggtcttcttttccaaaaacattgagcttctcctgtgttacaaactgtgaatatggaaattaaaattatacggtttccccactcatagtaatcaaagtcttgctggaaaaacagacatgtaaaaatgtaattatactataatgctacaaatccagaatggagagatgaacaaagcactgatagcaccgaggtgacagtatatttttacctttttcccctatattttctagttctaatgaaagtttgattatgatctaaattgctaatttattatatctacaaaataacttagaaaaatttgattttttaaaatcctataatcttctccctcagggttattgtctgtttcatctttttaattttctaattaaattctgtagttttccttaatgttaaatactggttagaaacatttcatgttaaacatacgcatcttatggatattatttgtgacagtctacaggtaattcagtgtttgatttatttctttaaagaagcctatattttgggtttaccattcacagggaaaatcggagcccatacttttttatctttctttattgagtgtggggtctcaaacattcattggtaatacctttgggatttggtaagaaatactgcacacagatacaatgtagaaatttcattgagatttttttaatagtaacttttaatagttaaaattttgaatagttgcttttgaaatgaatgataggccaatgaaaaatttgtgtgccatgaaagctatatttttatgaaaacctgattggaattatggaaaacaatctgtgttttatagtcatggaaacctgtgactgatgatcatttttggaatgttaattgtaatttctatcattgcagctgttaattggtaacaaggaggggattaaaggcattaaggagttttggaaaataaaacttaaacacacatcaaatagcaatcatttctggaattctgctcatattagttgtataaacctgactattaaaatatagaataaagtttatttcattattccagtttctaaactgtatattatttaaaaatatgtttgtatttacaaattaggtcaggagtaagcagggcctcagtgacgtaaataaatcccaatggaggcttgtctttggactttctcttttgtgtaattctttgtatatacaagatccttggccaagatcccattatacaaaagaaaaggtggggatgtgggggagggtgaatattcccagagaaattcagcctttcaattacttgattattcttgtggttgcaggaaattaaagaataataagtttgtttcctatgtgaatcataaaaaaataataagggtacacacagggccattgacttaaataaatggatggaccttaaaaaattcactttttggaggggtgcatcatgctttttgaggacacactgaaattttgttggtaatcccagttccaagcctttcaagttagtttaagtgtaggaagaggagtggcagcaactggataataaatttagtacaaatgtttattttatttcatttatgtattgcctcattcaaaaaatgattcgagatatcttttcttttttttttttttttgtcttttgaggcaggttctcacttggttgcccaggctggagtgcaatggtgccatattggctcacagcaacccctgcctcctaggttcaagtgattctccagccccagcctcccaagtagcttgggaattgtttttgtttgtttgtttggtttgtttttgtttttgtttttgtttgagatgagtttttgccatgttgcccagggtggtctcgaactcctgaactcaaagcaatctgcctgccttggcctcccagtgtgctgggattacaggcatgagccactgcaactggccctgatttgaaatatcttataagaacatgttcaacttaataataataaaatgtgtatagaagaaaaggtgcattatctggaaaagtataaataagaagaaagtcctaactggaaacaagaaaataaatattttaggatccatgcaattttgttttgattcattatttttatttatttatttttaataaagataggttctcactctatcatccaggatggagtgtagtggtgcaatcgtagctcacagcagccttgaactcctgggctcaagctgtcctctcacctcatctgcccaaggagtcttttttttttttttttttgatttgagctttctagcagccaaaacaaaaagagtgctgtggcataaaaggatagatatagatgccatgtcttttgccacacacgtgtgcatgcatacacacacacacacttacatactgtctctcataattatttatttattattagatttatttatttattcatttatttttgagaaggagttttgctcttgttgcccaggctggagtgcaatggcgcgatctcggctcaccacaacctccgcctcccgggttcaagcaattctcctgtctcagccttctgagtagctggggttacaggcatgagccaccacgcccggctaattttgtatttttggtagagatggggtttctccatgttggtcaggctggtcttgaactcccgatctcaggtgatctgcctgcctcggcctccgaaagtgctgggattacaggtgtgagccactgtgctcggcctatttatgttatttttaaaaagcaaattgctttcatgttccttaggagtggcacagctatgtggatctctaatttctaaaataaatttctcatacgtatgcttagtagtactttcgtttcaaagaactagcttacctgtgggtgatttcagaccaacctgttcagttcttctgtttgagagacaaattcaaatgcttatagttacccagatgaccacctttcacattttctatctcatcctagctaccacttctcccttaacatcacctgcaacaaacaaaatgactcccctaatctgaagccaattttaatttatgggatggacctagtcatttgtatccaaaatgtctgagagtatcttttttttttttttttttgagacagggtctctctttgtcatccaggctggagtacagtggcatgaacaaggctcaggcagcctccaactaactcctgggctcaagtgattctactacctcaggctccttagtagctaggactacaggttcgcaccaccacacctgactaatttttatattttttgtagagactggctttcgccatgttggccaggctggtctccaactcttggactcaagcaatccacctgcctctgcctccaaaagtgttgtgattacaggcctgagccactgcacccggcctgtaatatattttaaattgtaaacaaagttatcattgataagatatagaaaaaaatttaaaaaaaaattttatctagctgtcaatgagaaggaaagcaagctaaataatgaaaattaaattagcatgaggaaaatgaaaaataaagagagactggaagataccacataattatgtggctcataagtctaagagttttgaaataataattgagtcaggaaaagacttctgccttactcatatgtgcattttttgcatttaatattttattatatacaacttaattgtcccttagttaagtcctaatccactgaataaacaaaagtaattagtcaacataccttgcttagcagctttacctttttcaaattttattttgtttatttattatgtcatttccaaattcctgtgggccttttggtctgtaatctccataaaccactgtaggcatagacattttaatggaaagggctagtgacttttctggttttgtgaccttttacattctgattcaacaaaactttattggtcacccgcttatataacagtcactatgccaagagatttttcataccttatcacatattactttccataataaacccatgaggtaaatactttatggtccccatttaatataggacactgctaataagcctcagggagaaatgagcccagatcacattgctagtaagtgctaaattttggctcaaacccatcttgacgcttgaagccagtgttctttctatagccatatctcttgctaagtacttctgacttttacttaagatatagtcttctctttgattattaattactctggtgtgaactgtgatcttttatgaaatctaagactgctactattatccgggcaaaattgtggaattgaatcattgagatgctgattgaattgttgttgatggttcaacaattttgagatgagacagatcaaattttcctttattgaaatcagagtggttggagcttaataaaaaagcagaacatcttaaggtaaaagagcaggtacttttttctttttttttttgagacagagtctcactctgttgcccaggctggagtgcagtggtgtgatcttggctcactgtaagctccgcctcccagtttcacgccattctcctccctcagccttcagagtagctgggactacgggcgcccgccaccacgcctggctaattttttgtatttttagtagagatggggtttcaccatgttagccaggatggtctcgatctcctgacctcgtgatccgccctccttggcttcccaaagtgttgggattacaggcgtgagccaccgcgcccggccaagagaaggtacttttttttttttttaacactgacattagttctctttttgactgctaaggataactacaaatgatacattctgtaaaccttttgtctgaaataataaagaaagtgaagcacagtaggaattctttaaaatgttgtcttgttcattgggcatttattgggtacctagtataatccagatattctgtggtgttctgtgatacaaccttaaataagacaagacatagatctggctctcaaaatatttatagtctaagggggaaactttgaatttataattagattgttaattttcaaaaattaaaattcaataagttgcttattagcgtcatcggctttggaaatttaacacttttctaatgaagaacataagttccagttaagagggtttcctatttcagacaatgtagaataaatcagcttgttccataacttttaatatttttcaaatataactcgcattttacctttagaactaaagatatgtcgagaagagttcattataatgtaattgagtcacttaccaagcctattttaaaaccagttacttccttttcttactttgcactctgtgacacatagacttccagaatcagagaagtattgtttttgtttttaggcacttgctatattatgtggaaccaaagccaagttaatatggctaagtaattttcagttcaaggtaggatattagatagaaattctcttttctacttctagatttggacatgaagtagcttttcatgttataaaatgacaaattttatttatttgtaatgaaataatcccttttatttatagccaagttcatcattttaacacttaatcttccatgacagtccggaggagaagaaacttggcaaccattcattattatctgtttttatcatcagaaggtatttatttgtagggggagtgtagaaatgatgtcaagggtaggacatttttgtacaggacggcctttcctttggagtcatgatggtaaatatgaccacagttacttaaaatgcatgcaaatagttaccagtcaagatgtataaagttccctggaaactcagaagcatgtgattatagctgtggaatgagaatgcctaataataaaaggagaaaatgtcagttttggattagtgatttaggaatcccatcagtgactatctaatcagcagcatttcacccgttgttttacaaagctcttattgagctgtgcttccatacctttgggcttgtatgaagatctgctcatcatagaagcccacttacctatagtttcaacatgacaaatctgagcttaaacacaaattagaatatttaggccctgaggctatttcttggatttaaatatagcacatagtaggtgaactttgagcttgataatgctgtggtacagtgagagaaggccagtgtcaaggatatctgaattgatttgaccttttgtccttgcatgtgaaaatgacgtgcttctgtagaagtctatatactcatgacttccttctaaaatgattattgtacagtattctatggacatttgatttgattcttctcacaaaattatcgagacatccactagtgtctacttaattgatggcaaacaagaagaaaactgtaatctggagataactaggtaaaccacatattctacatctgtgcctggatagaatgacttttgtggttatgtatgcagcaaacacttttgagtgctggtcatttccctaagctctgagaatgcaaaagtgtgccgtgtccattgtgattattgtggtgaatacagagtgttgtgagagtaaataatgtggagggagtgagaaaagcctcctgtgaggacatttagctgagaaggaagggtaaggaggagacttaagagggcgtcagaagttctggagggaaggggagagtgggagtttgagggacaaatggccgtcatggtggagtgaacgaaggggaaagtcacctgggattaaggataaagagaattcttgagtaactaaaaaattgatttgttcacgttgctcagtgattctctgactgtgtttctttggggagaggcttataaaaattagaatgtccaagtcttcatagctatctaaatgttttctgcatgtttctgtccagcacctatgtctgacttcatcccaatttgatgattaggatgatgataaacaggatgatgaataatacaactatggagatttaaattagaagaaaaaatcttctttatctttttttattgtaagatttattaatacaaatctgtattgttattcagttctagaatgttctaatatgcttcttccatccaaagttatgattacttctttacctcatataatattattacattttcttacaataaaatacatttttaaaattcactattaaccctgtctgtgatgagacagcataatcttgtggttaatattagctcaggctctgtagccagaaaatacgggtgtgaattcttgttgcgtcatcaaagatacagatgtgagtcctggctgtatcattcactgactgtttacatttaatatgttatttagccttcaaaacctttgtttactcatctgtaaaatgggataataattgtaccagcctcctaggataggtaagatgttgcagtgaagtttcttgttacgatgtatttccttgattatttcataagacagaggaggcatcttttctgtgttcctcccttgagatactaaaatggccagggagcaggtaagttccaaagattaggtttcagactgtcatatacaacttgtagtccatctgtgcagctggagactaaaccaaagtgtcacataaaccttttcctaatcaaagtggttgttcatttattaatgtaaatgccctgtgccttggatgtgtgagtcctaaaaatacacttccagggataaaaatagatttctgggagttctgagatgctgcttaatcagaaccagctgcaagctgtctagaaaacgcaagttatatgagccagatggcttttgccctttttgctttagacagcatgtaatttggataactacagctacagtaatacattttgccagtcacagtgtttgataaacatgtttgttgagaacagccacttccaattagagacccagtaaaatgttaatttattttaataaattttccctctagggcaagacaaagaatacttttgacaggttacagaaatatctgttcatggaacagagtactgttcaaaagttattgtatgccagtgattaatttttcaatttggcatttagagaatgatgagcagtattcatgacctccccctccatttttctccttacaacctcatgtatatataagagaccaggatttttcatatttgaaattatgttgctttacgtgtagaaagatggtttagctaatttttaactttcttctacccatgtctaattactataaactctgataatagttactgaattattgcttgcttacagatgcttattaatgtggtagttcttgggatttttcttttatgatcgtattctttgagaagaaattttctctgttagtcttatgtagccatgactgattttcatcagctgaggactgcaaacgtagtcactgatattggctgaattctaattttattcagctcctattcagacaaaatagtaaagctaaatgtgtaagctattcacactgtaagacctaaactcagatacagcctacttttaggagatgtgaaactatcaattcttccattttcactggtggcaccacttcttggaaaagcgtatttaagccctggtttcccattacaggaattgaaatattctgtgctttatttcttgagacatgtctaccaggcatcatgtaacagactgtgaagtacctttgaaggatctcttgagtcataatttttccataattccagtccttccagctttgtaagtttagtaatcacccagcagttgtttttttccttccccagtttaagaggagagggtatttcatttccaggataagtgatattagaacataaacatcattataatagtagctacaggtttatttactcttaccaggaactatgctaatcactttatacattattgcatttaagcctcactacaacatagtattataaggtatatatttttattctgttttgcagataaggatgtcactattaatataacatttttatattaatagagtataattgttctagaattatcactagaatgatgattattcaacatcatacagaaagtattacagccagaatttgaagctactcttgtattaatggtgtgtctggctcaggatctttaattccacccattaagctatgaaaattggcatttgacctaactagggctgctttttcagaggtaaatgcatgcctctggccatcttcatatacttcaaggaatttacagtattgcttcttagcatttattttaagctcagattgtatgtgaaagagtctgatctctctcatcccaccttgttagatgaattataactgatgtgctttaaaaataattcatactgctggggaaaaaatctcactttgatgcttttccagtatatagttaagaattacactgatgggtagtaattgaagaaattggtaagcacttgtgtgatatgaaacagcataggaaacttatatataatatatgatagccattatatataagcttatatataatgtgtataacatttacaaaagcaaaataatacctttatgtttttatttaacaaagtgagataaattcattagtgaatgcagcagggcatacctgcaaattctgtcataggtagcaggaaataaagcaaagcattgtttataaaaagacctctttgttatggttctgtccactcaaagcaaactgatgggggcatggaaaagatcttattacttttgactattttggaagagcatactgttggtattattttcatttgcagctataaaatggtacttcttgaaagataccataaaataatagaacagtttatacttaagtactatggtatgataatgggcttatgctgtttgttagcaaagagttggtgttatttgttgtttcttggaaatgaaagggagaaacagataatattcctttctaataaatggattattctattctaccctattctattagacaattttatatccaaacaattactgaactctatttttcatatttcacagagttgtacgcaagatctagatttgaatatgaaatctgatacctccgtgggccagtcgaaaaaagcattttgatatcattagatgagagacattatagacatattagttctagagaaagtcccggtcctttctttatgtcaagagatttgtgttagaaagagccaacaaggcctatgcactcaattaatatacatcagttttctgttagcatgtaaggtcctatagttggtgttcaagaaaagaacatgatacatgaaaagtgatctttgccaaatgtatccatgtttatgctaatgtgggtaaattgttcctcttttaccatgtgaaggattggtagcttaatagtttgctttgcttaaatgattttatgtggcagtgttgaggatctgcagaagtgactgtgtccttgccctcaaagaacttttggcatttggcaccaaaagggggcactgctctcttgtgacataaaatgtagtccccgaatagtggggcttttgaaggttagtgactccaaaggaaatagtagatgaaaggaaaacgtatttacttcatctcatgggggtctttcttgccttggtcttcctgaagaaaagataagcattgggctgaaaatgtttgttatatacccttgggcaccattggcatattccaagctgtttttgtcaatcatataaatacatatttagacaatttctgaaacatttctcataaagaaagaagtcattcatctggtatatcatattcatatgcatgatggctttctagagttgtgtcatttcttcactatggcttctctcgtctcgcacctcttcagaaggcacccttcctttcttttttcagtaaataccacaattttatttttaggtgtatgcagcatgaaatgtatgtgtgtatgtgtgtgcctgcgtgtctgtgtgtgtgtgtgtgtgtgtgtgagagagagagagagagagacagagagagtttgagagatagaacagagagattgattaattggttgattgattagttggttagttggagcttttcccagaaagttttccaactgttcttattggcatatttgaaagtttaacaaaatctcattaaagttcatggatttcactgaaatctcttatttttattagataatcagtaatattataagtatacataatctgccatcccaatattttcaaattttagttctttttctatcgtattggtaagaatgttacagtttcttcctaatgttggtgataggcatctgtacatctggttttgttggaaacaactctgctaaatgtttaataaggtgctcattgtaagttaaagatagggaatctttattatattatagaactaccctggcctatgcacatgtattgagatgactgcatgttatttagcatgcagggataggttctgttttaacatattttgacctattgatgtcgtaacttcattagtagattacctagtattaaaccattctgggatttctgatgtaaacacaattggacatgttttattattatttaatatgctgttgggtttggaatgtatttcatctagcatttttgcctctatatttgtgatactgaatgatagttttctgttttgtcagctggttttcaggttttagtgtcagggttactaggcccatcacttatgattatacaagttgtacactgccacctataatattgtcatttgcatagttattatgacagttttacaaaggaggacagtaaagtatcttgaggaagggacttttttttaaaaccgtattgacttaccatatcaactagcagaatgtaacattctaaaacagatttttaaaaaattccatatttttccattccttcaatgtttaaaagaatccacgcaaaaaatcagtcaggtttatttgacaatagttgtttacttaaatttcttctagaactgttcatctctttagggtttatatattctactcagctgggatgatcttttaattttattgaactattaaaattcattctttaacaaccaactatacataatattctttataattcttttattcttttctgtgtttttcatcccccttttgttactttactattttatctttttcttgaatattaagatttgccttttgttttcctcttttttccttctccaaatacttttggctttatttactggaatgtaatattttagtatttgaaattaacaactgtttttatctttattattttttcctcttgctttccttagatatagtttgttcacttttttaaaaggtatttgcattgaatatttagctttcttattttctcttattttttattttcaaaggacctttttgggtacttttaaagtttgctaatttactgtaactggaacatttaatatggagttgaaccaactaacataggtgtgctatccatgtgagaatccttcggaaacatttagcttgacaaattgaaacactggaattaatcttaaaaatctgtattaggattgcattgacaatgtctagtgttttaaaatggcagtttattctctgattttaaaagcagtacaagttatccgtggatatttggaaaatatagagaaacatgcttagctatgtaacaattaccctaaaatttaacaacttaaaatgacaaacattaattttctcacacagtttctgagggtcagaaatctgggagaggtttaactgggccatttttgctgtgtctctcctaaagtagtagtcaggctgtgggctggagctgctgttatctgaaggcttgaatggggctggaggacccatttcaaaaatgattcactcacatggctattgactggaggccttagttcctcactggctattggcaaaagatgttggtttttttgccatgtgggccacttcttgctgcagagtgagtgatccaagacagagtaaagtggaagctacaatgtcttttatgaactactttcagaagttacatactggctgggtgcagtgacttgtgcctataattctagcagtttgggaggctgaggtgggcggatcacttgaggccaggagtttgaggccagcctggccaacttggtaaaactccgtctctactaaaaatacaaaaattagccaggcatggtggtacacgcctgtaatcccagttactcagaaggctgaggcataagaaccacttgaacctgggagatggagattgtagtgagctgagatcacatcactgcactccagcctgggagacagggagagactctgtctcaaaataaataaataaataaataaatttaaaaagaagtgacatactgttccttctactgtattccattgaccctactaaccaaccgttatacagtgtgggggataatgacacaagggagtaaatgccagaaggtgcggatcattgggccatcttgaaagctatccaccacacacagaaggacatagaagttacgcttaggtccaccattcagtccctgtggatcttccaggtttttgttttcccttccattgcagcagaccataaacatttcttatattatgaaatagtgttctaaaatgagatttttatatgtttgcttagtatccatttttagggcatgccaatttattttaccagtttcttaacattattttataattgggttgttttgagcatttgactattataaattataatatttcttgtctacaaatccttgagcacatctcctgccatttacctaaaatagattcctagaaatgttactcctgggtcaaggcatgtaaacattttaaggctttttacacataatgtcaaaatattctgcagaaatttgtacccaaatttatactagtattgccataacaaaatgatgcctaacttcttatgtgcttttcaatactaggtacaatattttaaaaatataaagagcctgataaggaatatagtatctcatggcagtttgaattttttattactaataaggtaggggaattattttaagagtcttattcttgaatctatgtagtatttttcttcttgatttttaaaggtatctttatcataattacttttaaagttgtaattagttctctttaaaaaaattatagtttgctttctttcaaaatttatttcactggatgttttcattaaggctatacaatgggagtggttctgtaatgaacctggaagtgttgaaaaataattgaataacttaagcactttcaaaataccaattagtttgttggtgactaaactaagtttctctaacttacattttattgattgaacatttgctagaataatgagttaaaaagtgagaagatgcttttttttttacttttgttgtaagccatctgccaaaatttggtgagtgctgaggaacatttgtcaaggaataaaatcataattgagagttgtctagtctgaaaaaataataaaaacactctcagtgtttccatgtgatagaatgagaatgactgttattacttcgaaagtttcctgcccaggactttcatataactgatgttctctgtgttgtacaaaaaagaaaataaataatagcttgctgaacagttttctggatttccaaaaaactttattttggtttttgatattttcataataattggttttaaatttgaaagttgttaagtaagtttaacagtgagagtggatagaatatgttgtctggcaaggcaggagcagagtgtagcagggagaccttggaataaggcgcttattttatagtcaactctgtttcctgccttgtggctttggtcctttcagcctgttttctcacctatacaaaaggaatacattttgccagatttgccagattattttcaaaactaagttatataatgtacacatagtgcctggcacacacaagtgcatgatacatgtataaagcaacaggaataactatggaaatgtgtactattcttaacataagtagttggaaggggagatcttcacaagaccataacaaaatgaaaaattcagtgatttgtaggtgaacattaaatttatgctataattctgaccaagagtgtatgtgatgggagggaggggaacaaatatttattttttgcaccagtgaagagttttgcaattatcgcattgctataaaagtttgctgaaagattaaaaatagaataatattagccatgactattcagaactgaagaccgtgccaaacaaagcaagcaatagactagcagtatgaactttgaaacccatagatgtgatgaattctgtggaaccagctcttaagtgtatagatacatagatgttcatgatttcactgggggaggctgatgatcataggtcttgaactggaattgaagaatgggttggtttgtacaagagtaagagagaaggagtgtcataagcccaggaatagtatggacacctacacagagacagataaccatgtagtgttttgctgtgaataaattgacctaacctagagaatctgtgtttgggatgcagtatggataggaatggtctgatcagaatactgagaaccttaattgtcaggcaaaagagatgaagcaaactgtagaccatcagttgaaaggttttagagactttaatgtagcagtgatgcagggtctctgtcgtagctcagatgtgggatgcactcttaaagtgagctcagtaagtcaggaagaaagcaatcagattccaaacactggaaccataatttctcacttatttcctactcaagaagcttttagtaatgttatcttgttctcttatgaatatgttgttttaaaaagaagaaattaaaatgtgacatagctgttgctttcctttggttgacctcacttttactttttattttaacactttatttttcaagaaaacacatactttgaaaaatcgtataattataattccacagtgacaatttctataatattttgcatttctattcctttttttttttttgtgacggagtttcactctttttgcccaggctggagtacagtggtgcaatctgggcttactgcaacctcctccgcctcccaggttcaagcgattctcctgcctcaacctccagagtagccgagattacaggggcccgccgccatgcctggctaattgtgtatttttagtagagatggggttttaccatgttgtccaggctggtctcgaactcctgacctcaggtgatccgcccacctcagcctcgcaaagtgctgggattacaggcacgagcccaattgtattcctttcttggaggtgtttcctatgacttatcctggctacagacctgctggaaagggagtagcatttatgaaactcctacattgtattatgcatgttagtctcagcatcccatttagtctttacagtatccttataaagcagatgatgttattcctattttacagatgtgtacactgagcttccagaaaattagatgactggtaagtgttagttcagaatgctctgctttgtaacatgatgcttcctgagagaatctggggaatgcacaacttttggcaggagaaataaggactaaactaagaacagcaatgttaattttttttttatgccttagagatagggaagttagtctccctcagaggaatccaacttgattttttctgagggatataatatctagtcacagggctgttcctttgcttcctgaggaagtgaaattcactaaattgggtagtgaccttccatatttaaagatacagttacagcttgctttagtaaaaatgttaacaaccttggaaaatgcaaaatatctgatctcaagaagattctgatacccttcattaatgaaaaaagaatgtcttgtttcctttctactataatgatcatgaattttccatgtcactctagttcctgaaagaagtgaattagtttgctagtagtgggtcaaaggtaactttctccttttaaaaactatgatgaaaggtgcgaggtttagatagtatggggaacttctgagtttctaaattataaaacacattttgaaatttgaattatgtgctgcttaatctggttcataattcttggtttcaaatactaatggaaatgttacttgcaagttaaaccctgaactgagaaacatgcttttctttattcttttataagtggctcttttaattgtagttcttttaaaaaggaagttaacacttaagtatctattaattcttgacaaggaccttattaaacctaagcaacgtgttttcaaaagggcaggtagctgttagctttatgtgagaaactaaaactaggaaagtaattattatgagcttcttaatcttttattttttccaaaatagaaatgtccctattttttcttattataaaaggaattgttaaatgtttaaaagtattgaaacagtactggacagtatacattaaaaagtgaatgtttcccataatcttaccccctacagatgaccactgattacagtttaacacatgtttttccagaacttgttatttgcaaatgtaaacctctattgctgtctacatatttaaaacattttaaatgggattgattgtactacatgtactattctttattttgctttttcttattgaaaattgttgttgatctatttccccttcagtaatgacagttctgtttcttagattgttggtttgttttgctattttaataacagtatgaagaaatacctcttttgtatgtttttgcacacttctctatttccctaggctaagttcttacaaatagaactgttaagggaaaggtaatgcatattttaaacttcaatatatgttcataaactgctctctaaaaggttttgccaatttactctcttgtcagtattgcaggagaaagtcctttttgactaactcttttacaataatatgaataacagtttttgccagtcaggtgagaaaaaagaaatgtatttctttgattattagtgtagttgagaagaatgtcatatgtttgtgggcctttatgtttctctcgggaacagattgttcatgacatgtaccttgtttttcttaagggtgtttgttttttctagtaatttaaagagcttttaatatagcctttgatacgtatgttgtaaatatttacatacgtctttttcttttacctcttatgatgatatttgttgcacaaaatacctaaaagttgacatatttacacacatcccattcttttttgcttatggtttctggcttttgtttgcatgctaagagtaaaaaccccggtcaattttttttttttttttggatgccaaggcactttatgtgcatgttcttattgaaacctcccagcaacccaatgaacagaatactttagcttcccttttatagatggtgggtaatcacttatccaaggctacaccgttttaaatgatagtgccataacacaaatacaggcagtcagatatctccctaggcccaagattattaatacaaacaaacaagaaaatctcctgtattgtagccactgtgttttctttttttaattgttaaatatttaattcctgtggggttcacctgtttaatttcattttcattttatactgtttatttatatatgcacatgtgtctacatgtttcctatatactcttattataataatcatcatttctttgtcagtaaaacattctttattctgattttagagtaatttttatatctaagggaaagtctccctctttattttgtctttaaaacttctctcgactattcacacatatcttttcttccagaatcaacatgtaaaatttaatgtacaaattctccttttaaaatagtctgtaattgcactaattgtaattgcacaattatcgtcattacaatatttatctttctattcaggaaaatagtatgtcttttaattaacttttttagtaaagctgaatagttaacttcatttagatttggggcatgctattgtaggtatattcctgggttaaattttgattgtgctcattattgttcacatgtacgtatgactgcataccattttgacagtgggtacatgttaaatcattactgtttatgaagtcagtgtccatttttatgaatattatgctagttcatgtcctctttttagacattcagtgttagagagtgaggaataattttaatgtcttgatggccaagactctacttaaccagctgttggtgactgaaagtccagtttcctttagatatgactcatagttcttggttggttcaaattctggatatcaatttaaaattgtatttaaaaccatagtggtccttaggggcccagaattcttcaaaattgaactgaaagtcacatagcaacatggaaataggcaggaagtcacatttaaattcttagcacaaattaacctccgcaaacaggtttgttccctgccctgccacccagcgtgggtgcttgtgtcacagtaggttctgggaagggttcagtattctcttgagattgggaggcacagaaacatcacacacattcacatggaggctctttcctaatccctccattactgctccctgtctcccataaccaagagaaaggaggcctttctttacaaagcgtgaccaaagattgtagaattcgaagttgaatggagagtgtataagaaattgaattcctaaaagaaatatgaggatgtaaagtaattacaataatcaaagaaggtcagagggaggagaaaggataataaagaggaggtaaataagaacatgaagaacattgaaccttccctttgtccccccaaaaaaagctgcagaggaagttggaggatatagaggatggatgaaaggggcaagacagtagaaaaatgcagcaaagtaaagatgatggaagtttagtaaaatggactgatacttacaggcatagttggcttaaaaaaaaaccctcactgatcctttcctttaaactgctcagtagctaaataaagaacttgttgatttctctctctttagcaggctctttcagtagtacattttgaagatttcttcatagaacattaggatattttactacctgactgaaagtggataaacagaactggaagatttctgctttgcacatttctgaagctttattttatccttatataggtaaagagagaagttatacactgagtatgccaaaatgaccacatgcttcacacttgcactacctctttttatgaatctaaatttggagttttcaaaacctcctgtttaaaaatacatcccaaaagacttctgcttattgcacattttgttcctgtcctgtacaactgagattttcatttataattctttttggaatgtttttctttttgtcataaatacaaaaggaagctattgacatataatccttcattatgttttatgcagtagcatcataattctcaaattttgagaatatatattttttctttcaagtctagagacaaatcttacaagaaagtttaattatgtgttcatgcatatacatggaatcttaaatataattgaatgaataaaaattaagttgccacaaattagtttatgcaggcatctttcacttaaaagatagtttggaggagaaaaaattcactgacaggtttttctattatatgatttatattttcctgttggatttcatgataaagttacagtttcattttatcaaagggaaaacttgttccttgatttttaaataggaagtcatattcagagatacattagtccttttaaaataacatatttaaacataaaatagtaatcttataaaatttattaagtcatacttagagtattaactgttttctgttatgctcaataaaaattataaattaaaaatgagggtaccagaaactcttaaaatataataatctatctctcctaattttactcataatataattcattaacccattattccatcttccaaaatgctaacttgcctctttccagctatcttgaaatgtacttaactgtaacatatctatactttaatgtatgtcactgaataagataaatttagagtatgtgaagtttaaggctgaatgttttgtggaattgttctttaaactaacccaaaataccacctttagactgctatagctgatactggagcatgtttcttgtctcaaggagcaaataatctttctaatattaaaccccagaatcagagagatgtacccatccagttttgggagtggtggacaactgcaggctcccctgcagggaaaagacttggcccctgtgagacatacagcacctggaggttgagcacatgctccctgtaggtgagctaactcccaggaaaaaaaaaagggatagaagaggcagactatacattgccctttttaaatctaccaggtcagtcactcctcctggaagaataagtgtcacgctagtagtgctccttccataaaaaaaactaaaggagtggggaagaatcattccctcccatagcaataatgatgtgtgtaagacagagttgatgaaaaaggaagtatggaatatggtgggaacatagcctagcctaggggttcattggaagtgatatttcagctgaaggaatagggagtaggattgaggaaggtgggtttgggcaagaagaaagatgtcttaacacatctgtggaatttacagcaattcagcatggccggttacagcctaggctaagagacagaatctggagtgatatagcaggatatgtaggcagtgaccagatctcagagtgagttgtgagtcaaattcagatgaataaagggcaacagaaacatttgaagggtttcaaatagagcgatgacagaatcagatttatgttttgaggggacaatcattctaactgtaatttggagggaagcaaagctagagagaggaagatctattagtggtatgcaaggaaaggaggtttgtgggaggggacgtgtagattagtatagttttataaattttgcccttgaagagcaagacattcaaataaagttgttaagaaagttagatgggtgcatacacataagtctttctgtgaatgccttttatttgaaatactgatcaatgggtttatgttaaagctagggtagccataaatttaattagccttctcccattttgatagagactttgtaatccttctgagtattttctttagttttctgatgaatccacttatttaaataaaattattcagttaaaaatttttttgaaagaatataaaaattcgctgtttcctgccactgtttactacaagatactgttgatatgtggtaagtgttctggtttatgggaggagaaaggaaagtttaagttcatttttgggaagacacatttccattgacattgaacttgctaaaattgcatgatcacacacaaagtgattgcacagcaatttttttttttagttgctgccaatatacaactatttaaaggctggactatttcaaaagataataatttgttatcaacattcttaggtgcagataaagagcctggaaccatgtctggtaaaacccttcccaatttacaccagaaagtctttggcaaaggtaatcttgtgctgcttagctgaaggcccttcagtatcaactaataatgtagcctgctgcctgctgtcattttttcactattagaaatattatcatattactatttttgtaccttttgtgtaatgttataatagcttctaaaggttttctcctaatattttgagaacttttgtttgcattcttgatttgaaacagtgtgacctgttagtgcctatcggatgaattatactctttgaatgtctctttttctaagccgctgtgctaatacactttttattcattttcccctgtgttataataactatgtttaagtctcatggcaatcttctttagtctatatatgctgaaaagatttatttgcatttctatccagaataaatcaaaataaattttgctggaaatggcatcatgtgaattgagtttctttagcttgcaatttttaatcattgtgctttatctggtggaaatgttaatgtttagtggcaaaagaattgtaaacagtgtttaacacacctttagtcacagacactttcatagaataaagggggttgtttaatactccaagaattactattcttatttgaattttatttctattgttgccaagtcattttttaaaaagaaaaatgatcccagaagtagataaccttttttttttttaataaagcagataaacttactgaaaatgacgtataaaactcaatttttctggtaggtacatactcttttgattaaaagttatcttaaacgccacatacctgaaaacacagttttacccattcaacaatcttgatgttcactgtcactgtgataaaggaaatccaagatattagatagcaatattctagagaaaaataaacaaattatatttccttcccctgatgaagttgtctagaaagctcatccaggccatggggtgagaccaagaagtgagaagttctagtgtctgaaaggaactgcagttgaaggactttattcttagcattatatatatgtatttttttaacctctctttggttctcagatcaacaccaaaatgcatgtgctcaccttctcttgtctttatgttttcagtaggaggaaggctggcattagcaatacaactttgaactcaggaagaaagtttagcctgaaaaagataggctgactagggtaaagtttgcagccttccaaactagcctgttatctttataagtttatgaggtagtaaaatggaaccaacatttctaacagaatacagtcgtgtgagcctgtcattctgaaagggactttatgtgtgctgaggtcaaaatccagtatgggaacccatgcagggcaggatccaggttttgtggcttattagacttgtgcagtttcatggggccctctttaagaaaaagaatgtggaattacaaatgcaaaattagtgaaaagatctcggaaggggcctatgcaaggaaagggccctgtacttaaacttcattaattcacaataaattcacttctaacctcatacataaacctgtatctaataagttaaattgtgaattgataatacagctaaatattttaaaatgagattgaatgtcacattcttgaggaaaccttccctgattgctttctttgtaatgccactgtgtcacatatacatggtgtggtaacgatccatttacccatctaatttgctcattagattctaagctgcagactggctaggatgtcttgcccactgctgtatcttttgtgcctagcacagtgcttagaaaattgtagttgttaaaagtagagtgcagggatgctggagtcacaacaccttcgaacgtattccagcagcaggctcggtgccgtgcctgatgtgccgaaaggtgcctctagtgctattacaatgcagacacagtttccatcaatcatatggacagcagctgccaagttctcttttacttggtgagttatggatggcaaagatgtctttcaactatgcacaaaaattggtaaagaactggctaggtgtccatccgtcaggtaggaaggagtgattataactgatctgaaggtagagtgagatacaaaatgccctctgaggatattttacttattcctgagagctgctgctgtctttgaacacctttgaacatttactttttaagacaattagatcaagggaaaaaatcatggaaagcatgattcaaagatcaaattcttcaatttgatgaagtcacacttcatctaactgggtcattgattttaaaccagaagcctatttactaattttacagcaaagatatttaactgtttctacaagtcatcataataaatgttatttctaatgaacagtgtcttgaacttaaataagagagagaaaaatagtggcatttcctctactccccaaataattctattattgcttaagtttagtgtttataagatttaaaaataatgggtgcaggttgggatgaggatctatataaccatggtggattatttttaatactgagaaaaacataggataaattctgcaagtactatactttttctgccaaaggagaaacatcctaaaacaagaaacttaggggctgatttaagaaaaagctggatgaaagatgtccagaccagctacataatttatagtgcccagtgaaaaatgaaaatgtgggaatcctggttaaaaactgttaatagtttcaagtcagcaacagcagagcattgaaccaagtgtggggctcttctaagcttggggcacatgttacgtgcccacgaagctagcccttatagatgcctttgcgtggttcctgagagctgctgtcaaagaccgtattcaccatgtaacctggtgaattgcaaagaaaaattcacatgataaattcctctttgttctcagcaccagaatagcatttatcacccgaaatgacctattacgttcctgtaattgagcaataggagctaccagaattaaatgttgtgctcaaatgaggtcgttttgctcagtctgggttttgggatgccatttcgttgttgctatttgactttgattttatatgcaatgttaatgggttttggtctttgtgttctaaggcatctcaaatccttttttggaagtagagacagtacgtaagtaaacaaaactcttaaaagtagttttaaaagttgattttaaaagcctatcatcaacattattcactggtggcagtaatagctctattaatgagattaatgcgttccaacaacataattattttttagagactccataactacaggcagaaataatccaggaaagcagaaggatgtgttccacataagcaagaatatataacaaattttaaatagtgagaaaagtatctttgtcttaagcaaagctcaggcaactaaggttaatggaggtgaaggttggggctagtttataattgggaatggaaagcccactggggacaagcttagagcgagggaactgctggcagacaaccctttgctgtggtgatacaggctcacttcagaaaatgtaacatatactcttttattccctgaagtttccaggagccttagctgggatcccagaacagtaaggaaccagtctggccttacagtgtgcatttgtgcattcttccccaatcatcccacaagaattaaattggattgccctttaagcagggctgccatgttcagttgtggaagattttccattgcatagactcattgggtaataggcagtggcatctgcgtttctccccactttacggcgatcaagctgcatcccctctcatggggctgtgctccccactacaccagtcccaagaagaggcaccatatgggctagtgtttaggactacctgagtcagctagataggcttagtaggcaacctaagtattcaagaatcccttaaagtgagaaaatgcctttccttatcaggaataaaaaacattgccaattagagagctctagaaagtgaaaatattttgagttaattttaagtatgaatgagtgctaattagagtggaattttaacagcagtcattctccactttttgataagattatgggatgtgaaggaccagagcctctatgtgggagttgggagctaggaaatgcagaaaattgatgcagaaggaaatagcgtttctcattacgttggctttggtttacatgcctccttcctaaaggacttgttaatttaactattacttgtatatgttaattgaagtactactcgatttgagtgtaattttctctaagtttttcttatcctttggtacaaagaaatcatttgtattccattgttaaaactgatgaaaacatgtgaaatcatacatgaagacatggaaagatacaaactgaaaaatgagttaacattgttgtaatattaaatgggaacaaattaatttccatcgaaggtaaaataatgagtgcatttgtgatttttgttgcttactcatcataattatgagacattatatttaagcacatataaaataagcacactttcacatttaaaactctagtgatcttctgtatggaacttacactgaaataactgccctagctggggtcgtctccctccttgattccatcgggcttggctgccttccctcaatatgtgttgagtgactactgtgtgccacgtttgttcctagaggatccaaaacccaaaccagaagctcccagggttgcagtgtaattaatatggggtgtaattatagccttttatgatagtctgtttctttccttgttactgtagtcccaacacttcctgagatgtgccctttaaccaagtttgtcccaagcctccacatcttaggaaaattataaacttttctgtgttctgtcttttctgtaaaacctttacctgtccccctagttggacctaatcacttcctccctggtgtttcacagagcgcctcaaaatttacttttctatcgtagttatttctatttgtgtttttatcccccactaggtttcaatgtccctagaggcatggattctaatgaattcttgtatctctattgctcatgatatttgcagaatgcatttctcataattggtacttactcaaaaatatagcatattacacaaatcagattggattacaataatggtttgcatgccaccagttcagggacacaggttgttgaccccaaatactgtagagccaggttgagttactgtcagcattcttaattcatgtttactgcataacagaaaatttaatgccctttgcccaattcctgaataaatccactattatcattctctgctcccctttctaatctgctatccatgcaaacatcatttccattaatttatgagcataggttcataataaacagttttgcgtgctgtactcttctctcagatatctaggagactcaattaaactaaaggaataagcaattttgtctataagtataaacttctgaaaaattgttgcccccaaacagcctttaaattctgagagaagcatgtctagaggtttcttatcaagcttcagaaagtacatccttctgaacatttttaatggcagctcataattgctgcccatatacatcagaggattacctaaactgggcttttcctgcagtgaaacagtgtctaataatttgagatgaaattctaattattttaatgagatttttctgcttcttggcatcaagcaatttgttttacacctttactcattatttttcatttttgaggacttaaatagaagagacatgacagaataggagtcctgtttcatctcttggaccattaattatgccaaggcggtttcagtactgatgagaccccaagaggaatgaatctttttgggtcttacttggtttaacggatttcattctttatacttcaaacaagttttcttagaaaaccattaatcactaaactatggattaaatagtgacaataatggaaatataaccaagaacaaattgttcatggttggtttctccaaggatttgacagctaatttataaaacaagttgtttttgttcagcaggacttttgtgactaaagtaaaattgctttggcaaaaggctcagcaatattctatagcctgtaggggaacggagcacacacagaccttcctccttctttcttgaccctctttccttgccactttttgcaagatttcaatttgcatacctgtcctgacttgttgccagcatgtgcccttgaaacagttactaagtttgctagtataaaaggttctgaaatttgttttatcttgtcaacacaaggtccacattggagagctttcaagacatactgtaggaaacttggcaaataggtaaaccaagtttttttttttcttaagtttggtcttcattttatatagtcatctgcatcaattacattcatagtttcataatccaaacaaacactgacataaaatatgtaagggttgctttcttaatctggacgttttcacctttgttggttcttcagtttgcctagctgggtgatgtgtgttagattacgtagttgtgtgtacaaagcgagagctttctcccttccagacacatgttatatgagggaggcagtgtaccaggtattacagagtgctggtaattaagcctgtgctgggaaaagtagggccaaaaccaagaacacatcttggatgcttccctcaagggtcttaggtgtagttggggaacataattgtatttaaaattgtgaataacagtaaaaagcagtgactgataaattgccaatatgtagaagagagaataagtgttatagaaatctagagaaggggtaggtaggctagagtggccaaactaatgttatttcttagaaattgaactgaccgttttcctcattcattcttttattccatctactcatttattattaaccaccttattaataaaaagcagctaacctttatttagctgctcaggcactgagtattatatgtacaactcatttaatatgccatcgttttgcagattaggaatccgaggcatagcatttgaccaacttgataatgagtggaagagactggtgagaaaccaagtctgtgtactccagagcctggctcttaaccagcatgtcctattgttttttgcctaacatttgctgacagcttgtcaagtagtaggttcacagagacagctgggatatagagatagtggaacaaaatccctccatttgagaaaccacagaagtaagtttgaaggccaaggattctgttgcaggacagtgatggtagcttctgaattcaggggaggcacacctgtgggaacatttggagatggagagaaggaagttaatgaccaggtggtagaggactttgaaagccagaatgtggggtttttgtttcatccatagcttcacatgtcatcttaggaccctctatttgggatccccccagagcttgtgaaaaaagcccctttgggatcctttgcccagagctcttgttcagattcttcttaggggtagggctctgaaatttgcattttaatcaagcaccctagatgattgttatcccatttgatgtggaaaatcactgctgcagataaaggagtacatatggtaaaacaccatatttgtttatattttaatatgttttgcttaaatgaaaacatttttgtgtggtataaaaaagagaaaatctttatcactttatcaaaatctgactatcactatattgaagtttaccagaggtatattggaaatatacctccgagagacccagtatgtcttataggcagtggtattctggtaaatgttttaacaacgaactctctgaaaacaatgcacaagttttgatttgtagcatttgttgatttcaaggtaccaacttaatgtcactgaacatggggttaggaagagatgtacacagttgggtccggttccccactgcctaactgcctatgagtttgaccagtgagtgaccggcagtattagaagtattagtgagtatttacaagaaaaaatatttatatgtatccaggttttataaacttttaaccacttaggctgattggaagttatttgcatcataacttaactttaatccttaactattttcaaagcatgatctcatacattacctttgaattttgcaaatattctgtgagattgccatggcagggaagatattagccttattttgtagtcgagaaaattgagagcaagtaaatttaaagaacttacctaaggtcacaatgctattaagagacaaagactgattatttctagtcatttctcttcactgtatactggatcaatactatgtaacaagctacaggttacaaccaagggggcctatgtgtacaatgctaagatactgacactaaggatatagtgaaatcataatttgggtatattagtagaggtgcttctacaactgcacatttctttgcattatactgtatgaatcatcgtcaagttgagacaggtagggtactccttccaccctcactggagttgttttgttgtcaaacgcagagatgataaacttgagagaaacagttcagagactggaaaaagaccaatgaggagctaatgtcacctggaagagtcttatccttgttccagtggctctcattgcatgatccctgagacctcctgcagcatcagcatcaactaggaacttgttagcaatgcagatccttgggtccccacctcagacctgcacacactgtgggctgtaatcgacaagtcttccaggtgactttgttgcttcctgaagtttgagaagagccctatatcatcccctccaacccagaaaccctagagaagtttgtgggatcttaaagaagagaaggcatgagtgtcttattccaagttgacagagtttaaatcagaagtaactgagtagtcactaattagattgcatttacttgaagtgactcaattaagttgtctgctgttagctggaattgggggtttaaggtaggaattaagttcagtttacggaaattaagatagttacacatcatacacacctgggtttgtagcttataaaatagaattttctatgtacactctggatgcacttgcaattttgtcctggaatgaaccaaacagatgaagtgaacagacagaccttggtgcctcatgtagtgtcaggaggtagttcatacacttggccgaattaagactcatgatgtacggctgtgggggtgggggcgacaaagcttttgaaatggcatgctgtggcaaaatatgatccacgtgagttttccttggcctttggcaccatggactctggccccctaccccatggccttgacttccctgacctgattgtgcttagtgcttctcctgcagcttggcaacgtgcatcatggtctcaactagtgctaccgactcatcccagttggcttgagactttctcagttttaacaaagaaattcccatgtcccaggaacctcttagttctgggcaagccagtagagttagtcactctgttcgtatcccacttgacttaagacctccactgggtgttttctttgctttttccactggtgcaggttggtcccgcatctttggcaggctggcaaccccagcttacactgttgttggttggggagccagggcaactggctacggagagttgctgtgaaagagtcaactattactttttgtacatgtaagatttgtaggaagcatgattagaagttatttttaggctgtgttgagtatttcttgctgatttggaaatatctagtcacatgtaactgacatagtaatttaataaattaccaactgcaatttattaaagcttggaaacatcttgctgtggagtgacttcaattaaggaaaatcactttgagtggaatttgaaaacttggcatggtactggggtattggttatttcgaataaatgggtgatacctgaaggtggaatcttaagaaaattaattctggcatatgtggaataaaatagagggattatgagtatggaggctcatgggagaacacatgttagtctaggattgagatgataaaggcacactagggagttaatggtcagaataaaaggaaaatttttgaaagatattttgaaggaagaacggatgaagtactgagctgggtaattgagagaatgatgacattattaatgaaaaataagccagcctaaatttagacaattgcaatgaattaaactttaggactggtaagtgtcaggaactcagatgatttcaaacagttaaggatttgagataaggcccaggagaaaggtgtgggctgcatatgttcatttgtgagcatcttatcaaaggtgatggttgaagcactggagttggtgtagtattcttgcatcagtaggtaggtgatcatcagaagcagacagctgagttgagtaatgtcaatggccataaatcttttgtttggtccttaatacatttggtgctatgaaattaacatttattcaggattttattgtggttccttccatgctattttagcagtgaaatttcagtgaaccaattagaacagtgaacttgattgcacatgctaatgaagatcttcttaattaacttttaataataaaaactccaagttctcaagagctagtttacttccataatgataaggaaattagagtttgagcataccaatagtagtgtgatcccttgatttctacagcatttataatttgcaaggcattttattattttatcaatgaccaaaaccctttgggacagttggctttctctctaatttatagataagtaaactgagtctcagagtgagtgcgttgcttgcaaaggcatgtagtaacatcagtcataaccacgtcagattgtcttttagttctttgaccgatgaactttccacagtgccataattgctggttgccacacattaacactagcgtagtgggaggttcctccagtatttccccagcgcagtgtagatttcagaagcttttgatgacatgccttcattaatcagagaaagatagaccctctatatatagaagttttgatggataaatatatctgacattgctataaggcgttagtaccacaatttttagattcagtcatcttcactgagaacccaggaataaaattaggctgattgagggcagaagaaggctgagccaattaaagaaaaccctgggaagccaggattaagtagcacaaagacaaagatgagtgagctgatgaaattgcacccctagctgaaaagcagcacacttgaaggaaaaccatagaatgttccgctaacttttagcagtgggagttacataatctaataattaattgtctgtagcttccagatctattagggaggtgtggaacagactccagaggcaaatcactggctcctgtgcaagtcaggaacattgccttaggcactcagcttcaaattggtaatgtttacaagttgttttccccataattttttaactctgggcataatctttttcctcttaatgggtattttaagtgtatcttaaagatttttcaccggctttacacttacgattggaaattgtctagtttgtcactatacttctgagtgtcagagtacacatcttatttttgttttttttttccccctaaaagacaatgttcaaaatacaaggtgatagaatatccctggcacactggagaaaaactgagatcatgtgcaaacagaaggatacatccttttaaaatagtttaaactgccattagaaatagaaggaaacccattttatctgggttactttgacagatgtaactctcacaaaggatgaatatcaaccaccagcaccctcttgtctgacattctgacttgaaaaggaagagcccctgcaaccacatagcatggagaggagataggagagaggctgtgagtagatgaaggctttcagtcatcaggggccataggtttcgttttgatgtacataaaagctgaccaaggactttgtgaaaactttgggctgccttcctgaccaccttggtttttttccttcacccgtagatcagcgtcattgacaactgcattcttttcaagtggcaaaaagaagttaaaaataaaattctattttagatgtacctttgattttcttcaaaaacatttcagatgacatgaaagagaaatacgtgataaattttagcagagacctggcagagtcttcctatagtttaatcaaaaatgggctcagtttcaaatatattaagttgccacaggagaatgggaatgacttttgggaacagttaatagttcctggaattttaatccccttttatcacaatactgggtaaaagttccaaggtaagtaggcaaataatacttaaaggaatattgcatgaaatgtaagaggtgacgtatttaaaagaagtatccttgtacagctcgcctttcctgtgataggtgctgcatgtttttttttttttttttctggataatttgtcctggactttgtccaggacagaaaacttcggtgtttctaaagtttatttagtcggtctcatctccttaacaatgtcagaagaaaccttttaacttggaacttggtaaaagtaatagaaaatattgtttaagatctaaatgtaagcatttggggtgaattctttaaaaaagtctggctatttcctagatttataactgcaaatactgtacaattaaaaccaccatggtattcctcatgattcttcctatttgggtattgatgaaggccttaatcaaccatagctgtttagaattttgagtgtagattgtaatttgggatattttctactggggtcctggatttgcattgtgttctgatttcttaccctatactgcattttcccctatggaaaaagtaccttccttgtattggaattttttaaaagattgcagttatttgtaatttgtaatcccccagtgtttctagtttatatctttaatgttgaaatatgaagaatattttattctattttccaaacagctggtaagagaattcctctgagaaaaaaatatctgcctggactctcacagtcgtctcctaatttatctttctgcttctgctttccatgatttaatttttttttgtacagtatccagagtgatcctattaaaagtcagatcacgttactcctctgctcacaaccatccagtggcttcccatcttatcagaacaaaatctagaaaagtcatcctcttccacggttctataagtgatatgcacctcaaatctttctggcctcatctgtaaaaaccctcttccttgttcattctactccacactggccttcttgctggttcttgcatacagcaaacacagacctacttcagggcttttgcatttccctttatctcttctcccagaaatttgcattatttgcctctcctcctttctttcaggtctctgctcagatgtcactgcatcattgagaccttccttgaccatctgaagttaaataggaccagtacttcaggtgtatacagagtccagaccgtgagatctttgatctcagaaattaggagatacccttaggggattagggcttcccaggttctagaattgagatggtcgttctttctaggtcttaaaggccaggggaccccagctaaaatttgggtaacttcaaaatacaaatactttcacttaagttacactgctgtttatcaactatgtgtctgtagttatttagtttgttaattgttactccacaaaacaaagtatatactgaaaattcataaagcctatctttttgcaaatgaaaatgtgatctaatggtctctttgtgaattccttcttggaaatgctccattattgtcatagttggtttatagccttccttggtgttaaaaagagaaaagatgttttctctttccattattgggagctcttttctttctgttgtttctgttcttcctgccctgtggctgctcagattctgtgtacagctgtttctatgaagtaatctgtgatctcctcacgttgctgcctctttgttgttttcactacatgtagaccacagtgtcacaataagacaagagaataaaataaaatgtttcctattttattaatgatttaaaagtccaatgccattattcaatgaaaagcccaagtcaacaacattttagtgtaatttagtgagaagtgttctggtcacttggctcaaccatgcctgcaagccaagtttcagtgtttcctgacactgaatcgcctgagtaccattgtggttatacatatggtgggatgacgtggccagttgaggtatatgtattaatatgctgaagaaaagagagtagtggcacttgcttcgtgagccaaaaaactgcaatcacttttaaatatatgccacaaggctgtgctgggatatgaaggaaggtaagatagagcctaggtctgtctagggattgggctgcttctgttatataaccacagcaagtcagttcagggattttagcaaacctttgggaatagcagggactgagctttagatgatggctctgaactgctggtttccaaccactagggtgctctacctgtgtcagattttcctggatcccatgcatttccccagtccatggtaaaggaatcactgggtatctgcttgtcattccccaatacacagcattctaccacattctgacttagaatttccttaccactattttccccccactagcctctgaggagctttctgaacatatagcccaactccttgtatatgtaaggcatttgttacactttgatggagaaatgaaattgtgtgacttaacaactattatattttcttttcattaatccttgtactatatttgcatgagtagaattttgtaaggttgtaagctctaggttactggaagaaacagaagtccgattgatttgttctgagaaaaatgactggataacaaagctaggcatatagagttgaatttaaatccttgagatgatctaacctgataatgtaacatcatccatctgtaatattttctcagtcaatttttctggtattcttcattttctttttgagaaagtgaagcatatatttatagcattatagcatatatttatgccattctctattcttaaggaatagagacagtattattttctcttcaatctgtatttcatagtgacatcaaagtaaaattctacttaaattgtgtgctaatcatagctttttatgttttcccttttctgccttctacttttttctactatatctccacttcaggtgcttctctcacattttccttaaatgtttctgtcagttccttagtctctacaattcaagagatttctatgaatctcttggtctattatgtacctttagaatggaagggtcttactagaaaaaaaatatttttatctgcatcacatttgttgacagaaagagaccttcatgctctgttgttaggtgcataaactagcacaaaacaatagatactgagtgctctacttctggaaaaacaaatattttgttttagctatttgcatatgaaaagatgtggaaggttacttatcaaaatattaactgattgagaatgtttagagtcttgttgattgcagttttccttctttcttttttccccactatttcatgcattcattcacatagtcattctttttctgtgcatttttattttctgattttctgtattactagtgtaaaagcaaacactaattgggaaaatatacaggaaaaaatgttcgatggatgtaaagaaataattgtgaacgtttatagcaccaatggtgctacgaaactattcttgacttccttttctttggttctaaggactaaagcataatccctacttctttggagctttggagggcttggattgtgtcttcctcttagagttagaatgatccatgttttgccaaagtgttcaagaaagggccccatgttggatgtcccttacagctttacctgggcatggagaaggcccagtcacacagtgatgacttgtagcctctggacaaatgtcatagaatggctgtgctccttccaaattccactcagagtggggacagctctactgcttgctgagcagtctccattcagaagtgtttcccttaaataatatggcaaaagccaaaaggtaagattggggaagaaaacgtggacctaggctaagatcatctcctctcccccactgccacctacatgtttgttttgtttacttgaatgaaacatggagctgttttaaatgtctgtgtaacacagtggtatcaataaaatgcagcttagttaaaaaatttattttatttttctatctgtgattacgttaagcttccgtgaaaatggaatgcaccagtttcacagcaggagaagatagatacagcaagattagggaggcaagatgttcaggattagaaggatctgtatggctgaaagtgaggtaatgataatgattatgtgataatagtactgttgtgctgttttgtgaggcagtaatccagctcccaaagcagataaactatgggggagaaggctgagtttatcccatggaggggaatagactgttgctgaatagcccagcatgacagtaaggctctttcttttttgaggcaagagctcaaaagtaagtttttaaaataaaacgagtaacttcccaaatacgaacaagtgaacagctgagcaagggtaaaagaaaatccaatagtgcaggagggtgaggggttggaggggtggggatgggattctttttatgcaacaaaaactggagttctagtcatatgagaaaaaaatttcagggccaaacacaaaaacaaaacccccctactatgcaaattggcagctgaaatgaagtggtattttctagaaaagtattaaactactgcaaaatgcaaacagatttccattcatctcattttaaatcactatttgttcatttcttgaaaacttgcttcatggaagggactgtaattataacagacaaatggcatattgtccttgacttctctgagcttacagattggtattgcttagtaagatgttgcggctaggcgtgctggctcatgcctataatcccagcactttgggaggccagggcgggtggattacaaggtcaggagttcgagaccatccttgctaacatggtgaaaccctatctctactaaaaatacaaaaaattatctgggcgtggtggcgggcgcctgtagtcccagctactcgggagcctgaggcgggagaatggcgtgaacccgggaggcggagcttgcagtgagccaagatcacaccactgcactccagcctgtgcgacagagtgagagacagagtgagcctctgtctcaaaaataataataataataataataatgttgcaatagctaaatcttcactttttcttttgtattcaggattgactggaaagtaaatgtcactcagtctgaggattcctccttcctgatatatatctatatctgtatctgtatatggacataacatatatatacatctctctattatctaatctgcatctatctatctatctatctatctatctattgatgcattccaagcttattcagttctagaaaatggaggagggatggaactcagtcctcagttcatactgatgtgacttctcctgggctccttgcttaggcatgtggggccaatttgatttggatgactccactggcagctggtttcactctaggacagctgggaaaattttgcttcatctcccaaaggtttactgcttagtactaattctttctcccttgcaggctgccagcaggcatccccttgtggtatcgtcacatcagaggctatgctatcaaatgggttcatatgtcttccaacctgtagaattgcaacccctgacttttctatgtatctggaagctcttagacaccccaagggatggagccacttctaacactgagacctcctcttctcctccatcttcaaacaaaaactctagctcagtagcctcatgggctgtagtcccagctactcaggaggctgaggcgggagaatggcatgaacccggactttgacctcccaatgcaaaggcccatttagcctctgggggagcccaccaagatagaacttcttttcaacttaatcactcaaaaaggctaacttcaaggacactgagattaccttcaatgttactttttgggagatgtgagaatgagaaacaatagctttcatttctcttcattgaagctaaatttgagaagaataagattaagttaaattctcaggagcttattctgccaccccgaattctccacaaagtccctcctgtacttaagaagagggagttttgtgctcgtttgttcaccattgaatccctaacattcagcaaacctcttggctcaggaggcctgatatatatttttgaaataatagtgaatgaatcaggcttaatgtttccagaagttagttaccatgactggatcagtcattgcttatatctgggaacactgaagagcattaattcacagataatcactgagtctatgtaccaggtgcttatctgggcacttggaatctgtcactgaacacaagggcaaagacccttgccttcatggagctttcattctagccaaggagacaataatcaatgaatttattgaaaaagtaagttatctagtatgctaggaaatagatattatgggaaaaagaagggttgagcagggtaagggagatacagagtaaggagcagtttgcattatgaagtaggtggttggcctcattagataagacagtgaacagagacttagaggtggaagggagtaaagtggaatttagggcaagagcactctctgggcagaggaaacagctacagcaaaggttggaagtctgcttggcatttttactttagtaaaatacacataacaaagtttacaattttaaccatttttagtgtacgattcattggcatttcgtaaattcacagtgtgcagacatgactactgcctagttccagaacatttttatcaccccaaaggagaacccatattcactaaatagtcacccccccattcccaccttcctcagactcccggaaattcctaatcttctttctacttctgtggatgtctttggcattttggggaggtgaagaggctcatgtgggctggagtctagtaagtgaaggggagtttcgtaggggagaaagtcagtgaagtaatgggggctgagccggatccctggtaagccactgtaagaactatgacttttactctgaacaaaatggagaacattccagagttttataccgaggggcaaaactctatgcaagagtaggtcgtatgtgtgagacagggtgagaggcagattgactaggaggttatcagtgtaatccaggtgagaggagataatggctcagaacagggtagcaagagtgagagtgctagaaggaattgaattttagtaagattttgaatctaggaccaagagaatttgctgtaggcttggatttgggatgagacagaaaggagttaaggattctccagttgttctaacgtgagcaactggaaggatgtagttgccattaactgagacagggaagctatggctggagcaggcttgcaggggaatatagggaatgctgttttgggcaggttgagtttgagatgtctggtcatctgaataaaggtgtcaagcagttagtgggatatgtctgtctggagttctagaaagagttctgttgtggagaaaaaacaacttgggagtcattagcatagagatggtatttaaagctatgagaatgggggaaatcgctgagggattgagtgtgaactgataatgagaagaggccacgtggtgagcactggggcatattctcctttagtggtgaggggcacagaaaaaaactataaaagaaagaattgaagtaggagaaaaatcatgggtgtgtagtgttttggaagccatgtaatgaaagtaaaccaaggaggagaggtcaactgaatgagatgctgctgaagtgatggacagttggctttagcagattgtggttggatcaaaagtcatatgggaatgggtttaagggaaaatgaaaagaggagaattgggaacagtgagtagggacaaatatttggaagactttctcataaaagctgaaaaaaatgagggcagtacccccttcttcggtgcctcaccttcactagaaagctccatatttcttaattattctaacaaataattatagttaattctggtgagtgatgcatttctttgcaaaatattgtctcagtttcttcctcacagtttctcaggatgctctttgtcatcatttaaaaagaataataaactaatgagcaagataaggagagaaaagaaacagatctgagagaagattctctttctggaacactaataataagcttaatattttacaaaataaaacacttttaaaaactatcctgtaaaggtcttatttatgtactttttataggttagcttataactgtttctataaaaactaagaaaatgtggaaaattttgaagtcatggggagaatatctgaatagcttttcctcctagtttcttggaaaaacaggaaattatatgcaagactcattttaaggcctttacagtgtttaatttacttaagtacataaaaatgtattatgtataacttattaaatgtattatgtataactaataaagtcgtgtctgggataattaaattttaaaaatatggtagattaagaaagcaattgcagatttactaattgaatttgctatttgatgtttttaattttttaaatcacaaatagggttctaaagttgttgcagtgaaatgaatttaacatttcttatatgctcaattaattgggaagcaggcaaacacctgaacaaccatcatactagtattgcacataaatagatcctgttttagctagttttatgctcgtatgacattaaaaaattttagagacaagttttctggaaaagtagctgtatcataaaggggagaaagcccttgaatgtattgaacatggtgggcatgaaacttggtggaattgttggcagtttttgaggtgtcactttccacagtctcttcaggcacattggttcatgtctcattccttctcgcatgctactctactatttcatttgatcattgttttacaatttccgaatgaaaatcagcttttttcatgcactacatgagagggaggaggctaaaatgcaataaatgatcttagaggattggtctgtaaaagtcttctcaccaaggctgtgggaaggaacgtttcctccaagaactatttggcttatttatctgctatgtgccaagtattatgctaaattctgtggtgcaaagatgagagctagattcattcattcagcgatttattcattcagtcaacatttatgcaaaatcatttggattattcaaaaaatatataaagacagtcattatcctgcaacaattgaaaatagagttaaagcttatttttgctttgtaatttaatcaaataaacaactatgctacttgctctaacttacttttctggctttttaagtcttgagttcaaactactttcagctggaatcttagggatacagttgaggacagtgctattataccagttttcccaaagctcataaaaaaatcctaattaatctttaacttatattctttacattttcatattttggtatatattttcttaaaacaagaaaaatttagtgaattcttaaataaaataatattttcataaaatctttcttcagtctgggtgtggtggctcacgcctgtaatcccaacactttgggaggctgaggtgggcagattgcttgaggtcaggaatttaagaccagcctggccaacatggtgaaaccctgtctctactcaaaatacaaaaaatagctgggtgtggtggcacgtgtctgtaatcccagctagtcgggaggctgaggtgtgagaatcgcttgagcctgggaagtggaggtttcaatgagctgagatcatgccactgcactccagcctgagcgacagagcaagactctgtctcaaaaaaaaaaaaaaaaaaaaacaaaaaaaaaactttctgaacagatctgttttttaagtgggtagttttacaggggagaggttatttcctaacgttccttcaagtgagcaaatctgtcagagtttgctgctccccacaggcacctaccattctacccccaaattaactctttcttatcaatgaaaggtatttccatttttttctgggagagaacaccaattaaatagttaggtaatttggtacctaatgtctttaacatttcttattaataccttatgaattataatattataatcttccttttaatgaataggttatactcccctgcaggtggaacacttagatgagaagttgtaaatatctttaaaataagggtttaattaattataaatatgcctgctaattttaggcaggattctactctaggaactggaaaagaaaccaagaaaataaatgtcttttcagctgtgaagtaaataaccatctagtgagagcaacagagtgagccccacattattcaggtggaattggattaaaaagctctgccagtgagataaaaacaatgggatcagtggtggactattgaaataggaaggaaaaccataccttatttagatatgatactcgtataaagatgttgaaatgcttttatttctctgcattgtcatatgattcaagttgggatgggcccatgtaagatagatgaagcagaagagcaaacagcattgggtttagaggcaacatctaaaacaatgtgattattttgcccctcacagaaattagtgtctcagtaaaagtaaatacatttcctgggcaaccagaaacatatgttgcatgttctttccagtacagtatgaatcctcagtaagacaaaaagagaatggttctcactaagcaaaccttccaacttttatgtccctgagccttcagttgctgttgttggttgttaacatctggctttccatcatcccacttttctcactcatagttgtgggcttactgtgggtattccttggtagtctatcaccaacatgagggcaagattagtagatcaaaatcttgtatgtttaccacttagctgagagccttacacatagtcactgctcaataaatattttttagcaaatgagttaccacgcaaatctcaaagcctttcttgtattaaattctagagtggtctttgaggaatcaccacactgtcttccacaatggttgaactaatttaaactcccaccgacagtgtaaaagcattcctttttctctgcaacctcaccagcatctgttgttttttgactttttagtaatagccattctgactggtgtgagatggtttctcattatggttttgatttgcatttctctaatgattagtgatgttcagcttttttttcatgtttgttgggcacatgtatgtcttcttttgaaaagtgtctgttcatgtcctttggcctctttttaatgggtttgtagaaataccatttgattcagcaatcccattactggatatatacccaaaggaatataaatcattctattataaaaatacatgcacatgtatggtcattgcagcactattcacaatagcaaaggcatggaatcaatctaaatgaccatcagtcatagattggatagagaaattatggtccatatacagcatggaataccatgcatctgtagaaaggagtgagatcatgtcctttgcagggacttggatggagctgaaagccattattctcagcaaactaatgcagagagagaaaattaaacaccgcatgttctcacttataagtgagagctgaatgatgagaacacatggacacactgggaggaaacagcacacactggggcctgttggagaagagtggtggggggagggagagcatcaggaagagtagctaatggattctgggcttaatacctaggcaatgagatgatctgtgcagcagaccaccatggtacacatttagctgtgtaacaaacctgtgcattgtgcacatgtacccctgaacttaatataaatattgaaggaaaaaaatacaaaaaaaattctagggtggactttggagaagatggagggcagggagattctaagaacaaatttttgtgacactctaaaaacaaatgaaagtgacattagtcattgagcttttgaattttttctggtaggactttacctgcaactaaagaaaaaagatggacaacctttaatcttgtatcacatcaatactgtcattaccttgtataaaatttccatttaatgcatgttctttaactatctgagtgataacaggtgaatgacatttttgtatatgcgtatgtggcttacatatttcccaattctgcaaactaccatgaagttagtattagaaacttactttgttatggttagatgagttaaaggagggaaattagatgcactgtatatacgtatgtccccgagagtgcactttccatgaatgatggcttgcatcttctcattttcctagatttttcacttctatcactatcatgcaaataattacaaatagcaaataattttaaatgtcagtaagctagtcttgagagcatgcagcatttactgtcatagagcaaaataaattaagtagaagatgaagtcttctgccttcatgaagttagcattcagtagagaagttgggacaaaaaaaatatgaaatatttgttgccatctacaagagaaatgtggaactacaaccatttgcagtgatcctcaagtcctgaagtggggcaggagtcaatgtggccactggttccaggaatggcctggagaactacaggcagattgtctgaaagcagagagcatatcaaccttctcctctcttcatgggtaacagatgcaccattaaaatgtgaacatcacacatgtaaatcttagactttaatgtttttataactgcaaaagtatagcttaattagacatatataatgaacctatcctatatgtaggatatatatcctacataccctaaggtgcatgaaacataggaatgacttcagaaatatcaaaattaggaatccttctctgttgccatgttttgaaggtaagatttttggagttgtatataattcattttttaacactttgaatgtattactttgtctcaagcctacttaacaccaaagcacattcataaaagcacttagctaattgtgaaagctagtaataactagggaatctgaacctgaaatcacatacttttttttttatttttgttgattattaaaagagaaattaagttatttgctcatgtttatattatggtaggtaaatttaactcccaaaccacaatcttacataggtagacttgcaccacgggactttgctgtacacattatttcatcacccaggtattaagcctagtccccattagctatttcttcgtgaccgtctccctcttccatcctccaccccagtgtgtgttgttcccctctatctgtccgtgtgttctcctcatttagctcccacttacaagtgagaacatacaataattggttttctgttcctgcattagtttgctaaggataatggcctccagctctatgttcctgcaaatgacatgaccttgttcttttttatgactgcatagtattccatggtatatatgaaccacattttcttatccagtctactgttgatgagcatttaggttgatcctgtgtctttgctgttgtgaatactactgcagtgagcatatgcatgcatgtgtctttataatagaacaatttatattcttttgggtatatacccagtaatgggattattgggttgaatggtatttctgtttttaggtatttgaggaattgccacactgttttccagagtggtcaaactaatttacactcctaccaatagtgtttaagcattcctttttctccaaaacgttgccaacacttgttattttttaactttttataatagccattcttaatggtatgagatggtatctcattgtggttttcattttcatttttctaatgatcagtgatactgagctttttttcatatgcttgttggccacatgtgtgtcttcttttgaaaagtgtctgttcatgtcctttgcccatgttttaatggaactgacaaaccacaatcttgattgcttaatacaataaaggattatttctcaccatgtcaccatccagtttgagttagtattcgtggtaaggggacaggtgttgggaacctttgctctgcccaatcttttaggaattccgatttcttccactgataggcttcactatcaaggaaggctgtggagtccccagtggatcctctgcatttggcctggaaacaagggaggaagaagtgtggaggattgtgttgaagggttcatttttcatccagaactggaggtgctagccatcacctctgaccacctttccttagccaaaatttaatcatgtcattccacttaacttaaaggagcctgggaaatgtaatctagccctttgctggggaggaaaagaaaacagagttttgaaacatgcagcactgcttctgccatagtgtttaaacatcatgcattgatgtaaaattttctggactttcaatatacatcaaaagtttccagcttaacacaaagtcaaatgaaaaaggaatggccaaaaacataacaaacaagaaggaaggcatatcaaataaattggtgaatttggaagcacctattttaaaagaaatggctgtccaaagacagttctagtggaaatgaaaggcaagtaactctatttcaaatcttggactaaatggaatagtgtaaagagttacctatctaggaatcctcattaagtagccatacacccttggactattcacttatcttctctaagacttgattgccttgtatgaatagtggacataatgctaatatatgttttcatgcttgctttgaagcaaacaattatatatatgagggtgtttgtgaaatattaattgctaaacaagttttctttcaggctagttgcattaaggaaaaattacttccaagaccacctgtaatattcacctatgactcatgaatttccagttggctagagtagcatagaaaggctttcagatttgtaaaatcaaggtttatctgaggtaacctttgctgcttgttggaagtatgtagctgagtaattgttcaaaaatagcaggttattttgaggtagaacatatgttctttaacaaataaaataagtgttctgaagggaaattttatagcatatttaatcacacacttaaaataatttaaatctggcagtttagagcactgtgtactttgatatgattttttaagtgctttattaagtgcagtaatactaaggtgagtactattgtgtggatttgcattttatgagtagctcttttcaacttctgtaaagaaaaaccatgtcatgaataaccaaaactgaaaaatgtagactaaacattttttatatttgatatgttttataaaattatgaatatatgctttttatatacacacatatacatatataaattataggtatgataaaagtgacttgtttcataagtcaaacaagcaaagaacccttttttatttatatcaacctgttaatgcatgcctcttggttgttggatgtattcatttaatagacatttaaagactaagttgttgttggtagtagggagcccagtaggtgttttcaggatattaacaaaaagcagccataacttccagcacagagctaaacacatagctgatattcatacacaagaaaaataaaatgtagtcaagccagtattttggaattggtcaggagacagataagtggtataaatatggcagagtgagattctttttaggttggagagccgggcaagacaacatcatgaggaaggaagtttttcattgattcttggagaatgggaaaaatttagtcatgtgacagccataagtcagacagggagcatggtatgagcaagacaaagggaggagctgtttgatttgcctggagaattaaataagtacaagaatattggaaaattattcagctcggaaacataggttgtggccagactgtggataaccttaaaagcccacagctttatggatagttttgatgatgtgacattgatgagttttcttttctttttctttcctttttttttttttttttttggagatggagtctcgccctgttgcccaggcgggcgcgcggtgacgtgatttcggctcactgcaccctctgcctccaggtttcaagcaactctcctgcctcagcctcctaggtagctgggattacaggcacgcaccatcacgcccagctaatttttgtattttgggtagagacggggtttcaccatgttggccaggatggtctcgatctcttgacgtcgtgatctgcccgcctcggcctcccaaagtgttgggattataggtgtgagccaccatgcctggcccaacattgatgagttttcacaactcatcatgtgatgtgattaaggaagcattgaaagcacagtttaaaaagccttaattgctgagatgatttcatgattattgttgtttctttagaaaccttgacatctcagcatatctaggacttttcttctctcaatatcttgaagagctaatttcgtttgcccccgtttttaggtttccacttcctatttttatgttgcgtatctgagattattatacaatgccccgtattttagggttcctacaaaagatagtaatgctgttgcttaagcagaaagtaatattgattctgactacgtggaaagtggggtggtaggtgaagtgaggaacacacaaagatataaaaccatgatgttataataataataatactgcataacatttggggaatagcaaataaataggatagaaaatacaattctgtaggagtttggagctgtgattggattttagaggagctagatggaagagttgaaaggacctctaactccaaaactgagtaatgaaattgatggtgtattatcaaggagcttcaggtaaatcatgcagccaatgaagagccttttctacctctccaactagtgtttctgtggcattgctttagcataattcattgtcatcagtaatgggaacaatcataaggaatttttgaagctgaatcttttaaaaagtaattgtgttaataaaaattttagttgctttatagtttttgcaacagataatggtggaatgtttaggaactgtggtgggtatattttctgtttcttaaaagttgaacaattccgttcttttattttctagttccattgctctcttatttgaacaggattttaagtttgtttaaaatacataaatgtggctgggcacaggggctcatgcatgtaatcccagcactttgggagggcaaggtagggggattgcttgagcccgagagtttgagaccagactgggcaacatagtaaggccacatctctacaaaaagtaaaaaaaaataaccaggcatggtggtgcatatctgaggtcccagctacttgggaaactgaggtgggaggattgcttgagcctgggaggttgaagctagagtgaaccgtgattataccactgcacaccagcctgggtgacagagtgagaccctgtctcaaattgtgtatgtgtgtgtgtgtgcatgtatgtgtgtgtgtgtgtgtgtgtgtgtgtataaatatataaatgtaacaaaacaaaaataagagaagaaaacattgggtcaggtgtggtggttcacacctgtaattccagcactttaggaggcctaagtgggtggattgcttgagctcaggaggaggatcgcttgagctcaggaggtggaggtcgcaataagctgtgattgcgctactgcactccagcctggatgacacaatgagaccaccctgtctctctgactctctctctctctctctctctctgtctctcccacacacacacacacacacacacacacacacacacaaaaagaaaaaaagaaaaagtagcataaattaaagatgaagttctacatagaatccaggtgctaaggtactatccattttgtataaataaatgacccacatacttgtctcttgagttttctgttagccacacaaaagagtgaacggtaggaggtttataagattggcactgtctgtagtataaaaacaaaccagctactcagaaagagcacaacccttcctaataccaactctaggcagaaataaatcttttctgtaggttctctgagagaagccccatagaatgtaatgagtaatgaatatccttaaaaacatccttacaagtagatagagaaaacttgttttagtactttaaaaatacatgtttataatgctttgggttaattgcataatgcctaagcatcatccagaaaaaacttttacagaggtcaaaaaaatgtgcactagacacaaactgtaagggagggacttagagccgggccagtcagtgtcagttcacactgcagcatcatctgtggcctcgttagaaaggcagactctccaaccccatctcagacccactgaatcataaccttcaaggcactgttgagaagcacatattaaagtatctaagttgacttaaaagacagttagataagccttcatgaatcatatttcccttaactgagtttagataaacattatggagcagtaaatttggagatttttctttgtgaaaaggaaatgaaataaatataaattcttttactggttaagcgtagatctattgcttttgcctttacccaaacattgggaagggtgttagacattcagttactatctaatatgggtgaagcactgggttaaatgagagatgtaaagatgaacaagacagacatggtaactgtttcttttatttattttttatttcagtaggcttttggggaaccggtggtgtttggttaaacgaatactgttctttagtggtgatttctgagattttgttgcatccattaccccaagcaatgtacactgtacccagtgtgtagtcttttgtcccttaccccagtcccaccctttttcccaagtccccagagtccattagcaggggcaatttagttgtaaacaagttgagggaaggaaactgcaaggtataaacaaagtgctgtgatggttatttctattctctagattttatacagaagaagaaactagctcagagaaataacttggtttagattacacagctaatatgttacaaagttaagaattgaactcaaggtctatgtgatactaaattcagtttacacttctgaaatatagcttcttgaaagaaaagaaagggaaaactattcagaaagtgagaaaaatcatactataaatcagtagcttctctattcaactccagtattttagacaatgtaataattttgaattacatctcctggagcaagtgctgtttttagttaatataaactgaggtgactcttgcagttttcctcaggaggtaataataaagtagggattcttcttctcctttttttttttttttttttttttttttttttttttttaaacagggtctcactctgtcgtccaggctggagtgcagtggcatgatcttggctccctgcaacctccgcctcctgggttcaagcacttctcctgcctcagcctccccagtagctgggattacagacatgcgccaccatgcccagctaatttttgtatttttagtagagatggggtttcaccatgttggccaggctggcttgaactcctggcctcaagtgatccacctgccttggcctcccaaagtgctgggattacaggtgtgagtcacagtgcccagccaagggattaaattttgccaaaataaacagtgccatgattgcagtcccctgccaccccccaataaaagtaagattttattgatatatgaagacaagcctgttttttcttttttgaaacaggatcttgctctttcccccaggctagagtgcagtggtgcagtctcagctcacagcaacctctgcctcccaggctccagagatcctcccacctcagcctcctgagtagctgggactacaggtgtgcaccatcatgcctggctaatttttagtatttttttgtagagatagaatctcaccatgttacccagactggtttcaaattgctggactcaagggattcacctacctcagcctcccaaagtactgagattacaggcgtgagccatcatgcccggccaacaagccagttttatcctcaagtgttgtgtgaggattcatgaagtgtttagcacacagcaggttttcaataaatattgattgaggaaaagaatttaatatttaccctttagatcacctttcgagcccacttttattgggtaataaaagagtagaatgaaaggaatatatttagaattttaaaaatcttacctcttttagaaacattttatagtataccagtcgtcatgacaatatgtgaactccccatcactatgtacttcatacttcagttggcattggccacagtttcccccatatcatactgatatgtatatttgtcttatattcccacaatagtatgagccttttagagagatctttatatttttctttcctatatgggctactgttaggtgtgtgtactcagaagatggtcattaagtatttaaatgaagaatgaatgatgatcactacaattattttaagtcaaatctgatctagcaacctgtgcctttatagtgagttcccaatggctgccttttaaacctggtcaaagccttgctagtcaaagatgatctatgaccatgcttctgagtatttttagtattgctgttgagagggctagcatttacggggtgctaattctgtgacagacacttttttttgtttttttttttgttttttttttttttgagatggagtgaactctgtcgcccaggctggagtgcagtggcacgatctcagctcactgcaagctccaccacctggattcatgccattctcctgcctcagccttccgagtagctgggactacaggcgcccgccaccatgcccagctaattttttgtgttttttagtagagacggggtttcaccgtgttagccaggatggtctcgatctcctgacctcatgatctgcccgcctcagcctcccaaagtgccgggattgcaggcatgagccaccgcgcccggccaacagacactatttaaaacattatttcctttagtcagtacaacagtcctaggaactcttactgtctgtagtggagatagggaaacaggtttataaggaattaataatttattgctcaagagtaagagtaaatgaataactaggagataatgaatgtcctggccatttattctcaaagagcatgaatatacagaataggctgatttgagacattatactgctttcttcctggaaactgactttggtggaatggtcaagctcttactttagaagtcataaagagctgtgtatggagaaggtaacagtcggtatgttaaaacaacagatccggccatagaataggtgcctaatggttctgaaatataagcaaacatgctggacaactttatcattatttctggcatggctggctctggggctcatgtttgtaatcccaactctctgggaggccgaggcagggagattgcttgagcctaggagtttgagaccagcccgggcaacataacgaaaccatgtctttacaaaaaattaaaaaaaaaaattgggtgtgcatggtgatgcaggcctatagtcccagcagctcaggaggttgaggtgagaggattggttgagcctggaagttcgaggttgcagtgagccatgatcatgtcactgcactccagcctgtgtggcagagcaagaccctgtctccaaaataaaaaataaaataaaataaaacatagttgtttctgacttagcagaatgtgttatattggaaactctatgcttctgtgaatccagtactgcaactctctcccactcatttaagaataaatccttaagaatcccaagaaataaacatataccacagttcagtccattgggccagtatatttataggatagtcacacaagtccagaaactgtcaggctgttactctgtgagaataatgggaagggttcttatcttcattcccactccaaagtaaggtttactttctagaagtgagatgcaatataaagtacccacgcaaaaggtttgaggcttatgcagaaaacaagcatggattaggatagttagggtttcatggagcatactttttccattaacaccaagaagataaatttagttgtctttttctgctagagctttgtggaatggagttagtgaagtaaaaggcatattccctttgtttttgttgcagaaataaatgggcaaggacactttaaagatttcgtgtgtgcattgtggctacttgtcctaaacataaaatcatacaactaaatgaaaatctctctttcaattcattttaacatagtgatttgctgcttattagtgcaatctggcaaaaaatgttagccaagcagctaatattttgtttacatttttgccctagcaaagatatatcaaatcccctgatgtacacctcttactcaggtattattgtaaaaatcaacaaggaccatttgaacactgataatactaaaaactgtcggttcccttattgtttctttaaaaataaaaccaaaacaaagcaattaactgcaaagggctatagtaacccaaagcaaagtttacatatttaaacataggggagtaaggaagtacagaagttaaacaacaagagagataatcttgaaagtggcaaaagtgacttatctcacttaaaagagtctcaataaggctgacagctgatttctcttcagagaccatggaggttagaagacagtggcatgacatattcaaagtgatgaaggaaaggctatcaagcaaaagttctatctgtagaaaaactcctccaatttttaaggagaaattaaggcatttccagataaacataacctgagagaattttccactagtagacctgttctacaagaaataccaatggaagtccttcaggctgaaataaaagggtattagatcacaattcaaatccacatgaagaaataacactaataaggtaactgcataggtaaatataaaagacagtataactgtatttttgtttgtaacattttttcttctgtctgatttaaaatacaatgacattaaagcaataacgataaaactatgtgtttggctaatagtgtattcagaagtaatttgtgtaacaataacacaaagaagagggtagagaacagagctatttagaagcaagattttatatactattgaaattaacttggtattaattctacctacattgttataaattgagataatattaatcaccagggattaagaaaacaactaaaatgcatactaatagaaataacaagggaattaaaatgatacattataaaatacagattttttataaaagaaggcaataatagagaaagagaggacaaaaagacagcatatagaaaacaaataacaaaatggtagacataaatcctaccttatgagtaatttatttaatgtaaatgtattaaatagtccaataaaaaaagcagatgttgaaagaatggataagaaaatattatctatttgtattctctatgtaagagacacatatgagattcagagacacaaattagtaaaagaatgtagaaagtaaaagaatggaggaagatatgccatgcaaacagtgactgaaagagagctgactacactaatatcagtatgttgtgtgtcagacccaatagattttttttaaataataaaaccgcatttttatgttacaagaagattttatataatatctgcatgatataccaattttctcataatctcttctgtaatattatttcattaacactctggtccacagcttgattcaacaagatcaggagggcaggcaggaggatgttaaaagaaaggtactgaggtgtaaaaggaaccaaacatttactgactcaggcacctattcttgatttctgttcacctgttgccttgaacaaactgcctgagctcatatgccttacctccataaggagcatgacctttgggaatttaccaggtcctcatccctgtggactcagaatcttgcttggtaagagtttataattgactttttttttttttgagaccgagtcttgctctgtcacctaggctggagtgcagtggtgtgatctcagctcactgcaacctccacctcccaagccccagcaattctcatgccccagcctcccaagtagctgtaactacagacatgtgccatcacacctggctaatttttgtaatttttctgtttttaagtagagatggggtttcgccatgttcaccagtctggtcttgaacccctggcctgaagtgattgacctgtctcagtctcccaaagtgctgggattacaggtgtaagccaccacgtgggcctggctgacacaatagattttaaaggacaataattttactacagacaaaaaaggacatgttgcaatgataaaaggctcaaaccatgaagaagacataggaattgtaaacatttatgcacccaaaatgtatgacacaaaattgacagaataaaatggagaaatagaaaatttaacaataatagttggggacttcactactccactttacataatggacagaacatccacaaggaaatagaagacatgaacaacactgaaaactaggcctaataggcatttccacccaacaacagtggaatacatattcttctcagtgctcaaggactattccaggctaagccatatttgctaggccataaaataagtttcaggaaaatttaaaggaccaacagcatgcaaagtatattctccaactacaatggaatgaaattagaaattaaaaaaaataagaatttagtaaattctcaaatatatgggaattaaacaatatactcccaaataaccaataggtcaaagaacaaagcagggtaaacatacatgtatatccatattaatgaattaatttaaagaatttttagtcacattatggcttaaaaataatttttcagtattgtccaaataaagtacctcattgccatgatgaaattggatacgggagatgttagcttgctaaaaatgacatataattattatgtaagagggacattaaaaggctaacaattaattttgaaggattaacattcttattttagaaaggatgactcctgttaagacattcttgcctatgcatacctgctgtttggattttctttctaatggaatagactagtttatattactatctatcttattgacatctcaaagcccttggtttaaattgatggttcagttagacaaaatcttaacttacaaggaaaagttgtttatgcaagtgaatttagaaatttagctatctatacttttaaaaacattggcagtatatctcagtggtatgagatagtccacatctttttatggactttttgttttattataggctttagtgccattaagggaaaactatttagttactctaggaatagccaaacattgttcccagaaatgcttgtgttatgtctgtcatggtacattgttaagttcagagcacatgtgtttaggagtctcaatgctggctgaagaatggaaaggacttttattacaaatagtggattttatttaattttgaatttatattaaatgatgaaaaaataggtcctgcaataatttagagaaaacctgtctcttcagggcaaggacaaatcaatattgagtgtttcaattgaattgatgcactttcaattataataatcttcatggtagttgaaaggcaggcccaagcaaaaatcatgatatgcacaaaaatattgctggaagcactatctgctattagctatctgctcatgctgtttaccttcacggaatttctaggttcaaaatcagccatttatttagaacgccagagtacccaccaaggaagcatattgtatagttttgttctgacgaagcatgtggctagaaaacaccagaaattagagttggggttacaaagagtctatgcacatttcttaagtctgagaggtttttttccttatgataattcagtagattcctataaatgactctttagtcacaagtttttttcatttagaagaaaattaaaggtatttaaataaataaataaataacatgcccattacatgttaacatgagaaacttttttaatgaaagataaacatattttcgaaaaaaatttaggagagtagcagtgtttgcattgttgcaaatagctttgatatttaacttaatacaagacagctggattttcatatctgcttctgcatgcaatctgtagcaatatgtgtttcaggttgagaatatgtggaaaatttggccttccacagataatattgctcaaagaggaagaagtattttaagaatctttgcagacaattatggagattattctataataccacaccgaaacttcaaaagtagtagttttctaaaggttggtcgcaatgtagaagctgacaccatatcaataatttttaatactcttattacattaaaatttgttggtctatcttgcactttgaatgggctttttaaccatgcttgatattgcatcactcactggtcatttggaaaaaatgtgtgtcactaaattatacagattttccaaatgctgacacacttcattgtacattatctaacaaaacactttcattaattacaccatttatctcattagaaaattctaagtattgacaagatatcatggtggccaacgcacaatttcaaaaatttaaagttttccttgaaagttctaattttattagcaacaattactctcagttattttccttaccgtgacaggcactttgggttcatttttgataagttataggccaaatactcaggtctgaataatcagttaattgaatcattcaagtaaaaatgttttttctgtttttaagaaaacagctagtttggcttgcaactcaaacaattgcacaagtacctttcctcaggacagacattgtgcatctgtatgcagcaggaaggctttatgtgcacgtcccatctcatcacacagaatattaaaaagatgcatgcccaacagttgacattcaataaaattaattttttcctgtttcatcaagaatattagtaaataaaatatatgttgtaggttttttcctaaaggtgggggtacagttttaagggatacaatgactgtaaatacactgtgataccactgccttgattgttgataattgacagcagcagttttacctgccatcacttctgtaccatcggtgcaaatatcaacacagtgagaaaacatataacatcttagtcttcttatgaaagtcattttgatgcccaagagcccatgtgccatgctttttgagaactagtgctttatttatatttatgatggagccatccaattttagagatgcaaaaacattaggtacataggttttaagaattttcaaactgagaaaaaaaaattacaaaaatcacatatttaggttttaacctgacttctgtgctgttcagctgtgaaaataaaaccatgttattaatataaattgtgaggggaccagtctacagcttctgtactccaaagtacattttgctaaatcaaggtcatatctaaaagacatggctttattatgatagtgtagtttagaaacattaaaacttatttctaaatttattttaattgactttataatgtataatatgttgttttgaaacatgtatacattgtggtgcagctaagttgagataattaatttatgcattatctttcatactactttttttgtggcgagaacacttaggaatatttctcttgcaatattcaatactacaatgcatttttattagctatagtcaccatgacgtacaatagatctcttgaacttattcctcctatctaaccgaaactttatatcttttgaccaagagctccccagtctcttccccacaacactgttattagtacctacccttctactctctacttctatgagagtaatttttatagaattctacctataagtgagatcatgcagtatttgtctttctgtgcctggctgatttcactgaacgtaatgccatctagttttgtccatgttgttgaaaatgacaggatttccttttatttgttaaggctgaaaggtattccgtgtatatgtatacatcacattttctttattctttctttattgatggacacttagtttcatttcatactttggctgttgtgaataatgctgcagtgaacatggcagtgcagatatctctttgacatatttacttcatttccttttgatacatacccagtagtgggattgctagatctcgactggaaatattttgtgcttctgcttctgtccttacatagctgtttatgatagacaataaatattaggcagatacctaaacactcttaaaataccaacaaaaaaacctgtgacaccattcttatagtatttccaattttactctttctttacatagtacttgatagaatgctgagcaccctgacttaacacaatcttaattgatgttggtgctactcagttattggaataatttaaaatgtgcctttcttgatcaattagtattttcattacagctcacttatttaattgatctaatgaaacactaagcctattagaatgtgaagaaatcaaagagaaatgtagaaaatattttataaaattcatctaacatatccactgtgctgtgtattttgcagctattttcaaaaagtttatgtccatgtccatgttttattgacacacatacagtcgatacatacattgcttgagatgatagtttctttgatggctatatcttatttctcatatacctgtaatatttagcacatagaatttgcatgaccaaagtttgttattagtttgaattttaaattttactttatgggcataagtttatgaactcatttccagctgagtttaagagttttcaagtgccagagaggttgcaagaaccaaattaaaaaaaaaaaagttgttgctgaaaattctctcttaggctcaagagcctcaattttcaaatgtggttgattttaattaaagtttaaagagaaaaagaaactattggaaagatattggaactaaataattcacttgtagtgaatagggagtttgtggtttgagttaatagtattcattacactgattaaaggcagtgagccattttgcccttgtttattttccaagccagtgtttccagtaatggggggtggctggtatttgatgttttatgtaatgaggtatttactgatgggctactttgacttctctacttaaatggataaccacttgaaaggaactgatcagaagaacagtttcttttctagagctggaccatttattccaaactcagacagtaagaaaacaattgaatagcttttattgccaccagctgtgctgtggttatttgaacaaatggaagactaaagtaatggtacaatctcattttatacagcattacacaaaatcaggattcttttgcctaataaatattgcatttatagttacttagatttccatcattatgatgagtttgctgccctttgagggttaataagtgggtctatcaaagttaagtcttctggaagttcagggaatgtgctgcttcagggcttatagcaaattcatgattatttgttttgcagatatacacacatatatacatacacatatatggaatatgtaacgtggaatatatataaataaaactctaaactttgaaaaattatagttcctcaaccaggaattctagtgatttgtatcacttggctactctagggctttggaaaaaatgagaagtgggtgtttaaatgttttaagaggtaattttccaagcaattgagcaggtagttaaaaataccttgttttcatttccttgcctgagaaaatcctaaagtctaaaggtttaaaagagagtagaaggaactacactgaattgggcctgaagtgtatgcaccagaaaagaagaccttcaccactcaccagtctccagagtttactgatcagtatatgaagtcattgtgttcgaaatatgagcatgggaagctgggcatggtggtgtgtgcctatagtcccagctactcaggaggctgaggtgggaggattgcttgagccctggagttggaggttggagtgagtcatgattgtgccactgcactttagcctgggcaacagagggagaccttgtctaatacacatatatatacgtatatatacatatatacacatatatatatatacacacacatatatatgcatgggaaccaggattgcctcctcctagttgggctgcctaaatatgtagttgcatggtgattgttggtgtgccttttgattcttataacttattaagtgttatcattgaggtgaaaagatctcttgagtttgatagagataagcagtccacacaaaagggctagacaggggtttctcaacctcagcactactgatatattgggctggataattctttgttgtaggggcctgttgtgttcgttataggaggtacagtcatatccctggcttctatctactggcacactcagcccacattgtgacaaccaaaaatgtctttaggcattgctagatgtccccctgggttggggcactgtgtagtggcagaatggtccttgttgaaatccactgtaatagacagtgaactcctagcaagtggtattggttctcggtcatctgtgtatcctcagtgggatatcttgaaagggcctggcatggagttgcttctcaataaatgtttgtagaaattaaacaaaaaaaaaactgtgacttagaaaagaaaggggatttcttttcctgttaccttctctgccactgatttcctgttattggtagaacaggcatagaataaaaaagttcaatgctacattacttataaaaagcaaaagctcagaaaaacttctggatgcttaataatatagaaaaggccaagtacattggtactttcctttgtgggatatggtacatttcttttgtgggatactaccttcataaaacaggttgtctatcaaaagtttaaacgttattttttctgtaaaaagttaggctataaacttacataatcatctgtttttaatatgtatgtatgtgtatacatacgtagtatattatttcttggtgaaaaaagagtaggaggaaaaatgctaaattattagtcatggttgcttttggtagtatgattacattttatgtgcaccttctgactaattattgagaagatgccttctttttctttggtcttctgacaagctaaataaaaccaatagaaaaccagccaagtctgagtgaattttatatcatcattggaaatggattttttcattttttaatgaaaagaaaaataaataacaagttaacaaaattttccctttaattttattattcgattctgtgtaacattgttaatttgcaaaaataaatttagcattaaaattgattctgtgtgctaaacatagcctggaaaaaatgctcagggtatttagtaactactatatggaagtttcttaaaaggtagaagaaataatttctacaaagtttgtctgtattgcaaacattgcagtgtaatattgattgtttttcactattattccttgtgattatctcatggtaatgctttcttgtagaacgtgtaattggggaagaaaacatagatgttgcaagtgtacagtgtgattttaaaagaattacctgttttcaattagagagataatgtggctatatacctgtatgtatatatactctatgtattgatttgtgtattgaagtgagattgtaccggagctttttgtgaaatactcccagctgtcttgcctaagcacacattagatacatacattttagaaggatccataacttagaacattagtggttcccagttttcctcctcaccatggtgttggactgaacagcccaagtggtatatgtattcagcctgccatatgtttcagtaagagcaaacatctggtaccagtttcccccttgcttttcttgatccagctgtatagactaactttgaatcttagaaatgctgcagtcttccatttcatgcatccctcagcatgaagcacattttttttcacccgaattcctacatttttattaagccttagtttgaaagcacttcttcaagatgggcatttcgtgatgccttcttccttggatgctaagttgtgctcctgacaccccatgcttcctttgcagcagcattttaatacaggatggagaaccctcctttgatacctgccttctgcaggaatctataagcttctgtgaaggcaaaaatcagtcacgtcctgttcaccacagtatctcaggcatctaacaaagtgcccagaacattgatagcatttagtaaatgatgaatgaatgcatccataaatgaaggaaggaatctgttccaacatctttgagaggaaagagtcagaagcatcaaaaattaattctcaaataatagagattagtacaatatttgttgaacaataacagccattgaaagcgcattcatcaccaatgtactgatttggaaatgtgaagttttggaaatgtgaattttagtaatatcatagattattatggaatggcagtatttcaaatgtttatgttttacaggatgagtgctaactctaccagcaattatagtattaacagtttcatcaaatattttccttgtttctgaatcttaccagttgtgcataggtgctttcctatttgaaagcagcgcatcattcagcctcctgaatgtatttagaccttgtaagtataattaactctttcttgacgggggcatatttaagattttttaaaaaatacatatatagtgtgttgcagcaaaacctttctaagaaggagtcagtaggatgtagggataatttttttctacaataaatatttccagaccctttatttataatcaatatatgaataaggaccactaaatttaaaatgtttaatgagatgtgtatagaaggatcaaaaagatatatttccacagttacaaaatgcaatggaagctgtctctaacactagctatcgaaataaaagaaacctcgaagtaggcctaatcaaagattcaaaatatgttcatgtacaaaaatgatttttaatgaaagtcatttaagaagatttaaatcaatggagaaatactatttttatggattggataagtcaatgttataaatttgctaattcttttcaaattgaggtatgggttcagtaaaattctaatcaagaccttaacaaatttttaaatagaatttgacaagctaattctcagatttatctggaagagtaaaggtcaggaaagaaaagacaaatttgaggagaaagaataaagtgggaagaatggcattataagataactagactactgctactactactactactactactactactactactactactactactactactatttcttcctcctctttctcctcctcctcctcttcttcttcttcttcctcctcctcctcctcttcctcttccccttcttccccttcttcgtttttttttttttttttttttttttttgaacaagacaggatgtctgttgccctcgctggagtgcagtgacatcataactcactgcagcatcaaactcgtggacttaagctagccatcctcccacctcagcctcctgagtagctaggactacaggcatgccacaccatgcctggctaattgttaaactttttttgtagatttagggtctcccttttttgcccaggctggtcccgaactcctggcttcaggtgattctccctccttggcctcccaaagtgctgggagtacaggtgtgaaccactgcagccagcctagacttcttataaagccataaggtatattgtgtatagcaaaatagaccagactggagagccagaaaggactaatttacacataatatatacatatctgaaagaggtgtcattgttgatcagtgggaaagggatgagtcacttagtaaatggtgctgggacaaaagtttgaaattgtatctttacctcatgaaagcacaaaagcaattccagataaattacaaattaaaattggaaatggaaattggaggatatttgtgtgatatagggaaggacagtagtttataaacaacattttaaaaagcactaatctcaaaggaagggattataattatgaataaaaatgatgaacattaaatataacaaagaattagcattcagaataccaaaaataatataagtaacacagtggaagacgggacaaataagaatagttaatcctaaaatgaaacccaaatgtctactaagcagccaagacaaggattagggaaatgcaaatcaaaactacactgttatacaattttacgcatctatcatattgacaaaattgtgaagttcaatgtcaccaggtgttagtgaagatacggagcagtaggaaatttcataattctgaggaatgtaaattggtgacacctgggagaaaatttcacctatatatgtagtaaagtttcatattttataaggacccagaaattctatgggaagtataatccctagggataccttctcatatgtatacaaagggacatgtacaggaatatttattcgggattgttcataatattaaaaaaatagaatcaaagtgaatagccattctattagttcattttgtgttgctctaacagattacctgaggctggataatttatttttaaaaatagttttatttggctctcaattcaagtggctggaaaattgtctgcatctggtgaggtcctcatgctgcttcaactcatggtggaaaatagaaggtaagcaggcatgtgcatagatcacatggtgagagagaatgcaagagagcaaatcagaggaagccaagctctttttaacaacctgctctcaggggaatgaatccattcttgaaaggccaagaactcactcacccccaagagaaggcattaatctattcatgaaggatccacccctatggcctaaacaccttccaataggccctacctcccaacactgccacatcagagaccaaatttcaatatgagtttgggtggggacaaaccacatcccaactatagcagccatcagtaggaaaatggataaataatttgagatatttttatgcaatggaatattatgtcggtctgagaaagaatgaactagggattgacatattgtcatggacaaatctcaaaaatatgtttaggaaaaataagttgcagaaaattattatactttatcatttatataaagctgaaactatgcataacactgctatatattctttaaggttatgtacatatgaaataaaacacaaagacatgcttcagaatgataaattcagaatttcagaacagattatttgtggggagggatgcaatgaagcttcaagtctatttgtaatatatttcttagggatgggggctgtgaatgccatttacgtgacagtagccccaaatttgtatgtctagcccaggcagctttcctgaacttcaggcatgtatatccagatgatctggtagccttctagaatggccagactgaattgctagcatttcagcaaaattgctctacacacagtgtttcccatatcaattaatgacacttacttctaattgctcaggccagaaatttttgaaaaatcattgaatgttgtcttttcctcatgccctaaattcagtcagaaactcctcttgtctgtaccttcaatacataaggagaggcctgttattccttctcactttacagctaccctcacagatctatatcaccacaatcttttgcttagattttcaaaatagcttcctaattggcctctcagctttcaccccagaaactcttcccagccccaccgtttattcttaacacagctgccagaatggtcctgttaagtatgaatcatgttgtattactctttttctcaaagcccagcagtggctccctatttctcttccagaaaaagccaaagtcttaaaaggcctcaaaggcgctgtgtggtatggtccttgccatctgtctcacttcattcttttaactctccccttcgttgaattgctgtggttgcaagagcctccttgatgttcactggacctgcctcaagtgctcccaccagacatattttatccttgagcttttctctcaatctgcatggtcaagtacctttatgggtttgtttacgtggcctttcccttcctcgggtgttttctcagaagtcaccataccactgagcccttcactagccactctatttaagattgtaacactctcattccatgcttcgtttttgtttatagcacttcctattttctaacatacctgtcatttacctctgtttagtgtacactctttattgtctgcttcccatgataaaacataaagtttgcaaaagccaggatttttgtctgtcttatccacaggcatatccccagcaccttgaagagtacaggtatagtagactctcggtaaacatatgtttaataaatgattgaatgaatatgcacttgtttgttatgttattctgtgtatctataatgtaacaatttaaagaaagcacctggttgagaaagatgccatggttcagtggtagatactaaaaataattgcaatcatagtatacatttttatcagattttatatctattcttatactatagcttgactccatttttaacctgtatgaaactaggaatggaattaatggtaggccaggtgtgcacattgaataggtagctcagagtaatgaaggaaaaggcaagaaagagctttcccaagagcaagtgtggtattgatacagtatttcctttataataccctttaaactcttatatggaaccttagaaaaacacaaaacctcctattttctacaaatacttcagaatgtcttgcctaatgcattcagtttgtgtcagcttcttgatattattttaacacatctttctgtaattgttttttaagtgtggcactcgagttttcaggagtgttctgagctgtgattgatcatcatacatgcattttgaatagggacatctgtctctgcagcatattatgtctcctgacatgccatttctcagcttgacagagcacctctagagggcataggctttaataagatagaatatgtgacttttttttacttccatagacagtgagtggtgttacattttataatgaaataatgaatagctgaagtgacagcttacccaatttgcctttcttcgtgagccaaatataaaactagaaataaagcttattcattttagcctgtctaatatttacttcaaaaacattttaataggacaatatttactaaataagttttcttgtattcatagttgacagtgacaaaaatggcttctttgtctttttctcctaaatttttctctttttatccttatcattttttctatacctaaatttttcttgcatccttttatatgagcaaattgcctctaatcttgaaacatatagtttattaatttgatttgaaatttattttgatgttatttttaccagtcattcagtaatcatagatagttacattgttaaaaaaacaaaacaaaacaaaaaacaaaaaaacaggcacaaagctagatgaatgagcgttgtgtggactctgccctagaggagacccaagtttagtgtgagaaggagataggaaacaatgataaagtttgtgcactccagaagaagtaggagcgatcgcctgcggcactgaagaaacagtggcaggctctgcttggatggaggacactggccaagtggtcaagctggcagagaaggcaactgatccatgtcttaaaaagtgcatgtgcctttaccagcaaaaaggagacgagatggggcagacaagcagagcagcaggtgcaaattggaagagtggaaggttttggcctgttgaaagaaagatgaaaattacttgtacctggagtagtaggtgtgcaaggtgggaggaggaggatgacagatgaagctggagaagtaaatttttatttatacgtagaacttatagttcttttcttccattttgatattgtctgcctgactcaagtatcttattttacacccacaactgcaaatatctcccgtcatttgaaagaagacttactggaagtcattttcctacctcattttctcatttcctgacaacttctttcgactgtcttgattaatttccaaatatgggaatattttcaggtcccatggtcaaagattttattaaaaagtcttacctctgattcagctaaatggttagtcaatttactaattaataggaaatgctttgtagttataggtaattaacatgttaatagtttaaataaaattgattgattcttctctttgcttggttaatttaactatcccagagatcaagttttaaaaaaacttgttatcgtttagctttatgcaactaattaccgttagtcctttaccatgtctatgtcattgcacttgcttcttcagctagtgacatcagaaccttcacttcactagcaacatcgtacaaacaagaggaagcaccatcttgaacttccacaggaatctcttcctttcggaagtattttaatcattacttcaccagctatgttccacttctggatattttggtaaattttccgagcatttagaagccacatatcactcctttcagttgcaggaaattggccttttatatcagaacactgtgatctgtgaaatgggtactcagtgactttagaacacgtcaagagattagcttcgtgtctagagtctgcctaaacagttccaaggtgagatttgttatttcacatttagcaatgatttaaaaacaaaaacatacgctttgaatggagtgctttattaaaataatggaagaacatggtagaggaagaactccctgggaagagtttaaatagtataaatagctttgctgagagagcaacaaagttctgtattgtgctgttgccacagcagcaccaataattcaaaacaaggaaatggagtctcatatttaatataatacagacttttccctagaacttctgtggtctagggtttttcagggattggcatgtttacatatgtctaaatttagacatgccttttatgtaatatgatgaaagagaagtacttaaaattctatatgatgcagttatttcttaaactttttttttgttttaaattgactaaaatatcaggaattttctgtgctgaagtcaatgccccaggacattgtgaatttatgcatatgaagggagacataatctcttatgcaccccacatttgattttaaaagatcactttgaaaagtatgaagaggtgtttagtaattcaaggaagaaaaataatttcttttctattgaatattctattgaacattctataacaagagttttctctgctgtggaagtaggtactctgttctgaaagtcaggatctggaaattcagaaacacagatacggacgtttggggaattttaaagtaaattttatatgtcattttggaaataaattagaaagatatcggaccaatctcaggcgtggacagaattcaattcatcattcaataaagtacaactaaatctctaccaaataacaaaatccagtcataataaaagctcgcttacgaagaaatgtttgactgtagcaaactgctttttattaaacgtacttgacacaacacaaggagatggcagtgtgctttccgactttcagatttttgttgtcccaatgttagttcatctcacagcctgcctggcttttccaccaccaattttatccttgttcttactaaagagtaaatttgtaggcaagtttgattgttatgagataagaataaatgaaatggttagggaaattttcatattttgatcttttctacccagtgacatcatgatgaagatgatgcaaaaaattggtcagatatatatctagtatgaatgtgtgtttgtatttactttttttttgaggcaaagtctcactcttgttgcccaggctggagtgcgcagtggcgtgatctcagctcactgcaacctctgcctcccgggttcaagcgattctcctgcctcagcctcctgagtagctgggactacaggcgcccgccaccacagctggctaatttttgtatttttagtagagatgggatttcaccatgttggccaggctggtcttaaactcctgacctcgtgatccacccccctcgaccccccaaagtactgggattacagggtgagagccaccatgcccagccacatttactcatttaataaggacaaatattgcctagaaactagtttcaaagaggcctgattcattttttatgtaaattgaccaaatattatttcttgcatgaaagctttattaaggaattatgatgtaatttttcatttatctcttctggctagtgtcgaaaggggaattctgagtgttgaaaggggaattcttagagatgtaaaaaaataactgaattacccttaaaaagattgaaaagttaaaaagcaaataaaaagaaaatgaaaatatacttatccatttagcaaatatttaaggacctacgtcagttatgtttctaggcactggaaataaaatgaatattgaaaaagacaggataggttcgtgagacttatgtataatcaatatttaaagagggaatttgggccaggcacagtggctcacccatgtaatccgagcagtttgggaggccaaggcggaaggattgcttgagcttaggagtttgagaccagcttggataacatagtgtgactccatctctacaaaaaagttaaaaattagcagctgggtgcagtagctcatgcctgtgatcccagcactttgggaggcccaggtgggcgcatcatgaggtcaggggttcgagaacagcctgaccaacatggtgaaaccccatctctactaaaaatacaaaaattagctgggcatgatggtgtgtgcctgtaatcccagctactcaggaggctgaggcaggagaatcactggaacctgggaggcggaggttgcattgagccaagatcgctccattgcactccagcctgggtgacagagcgagactctgtctcaaaaaaaaaaaacaaaaaacaaaaaaaatagctggcgtgttggcctgcacttatagtcccagctactcaggaggctgagacaggaggatagcctgagcccaggaggtcaaggtgacagtgagccatgattgttccactgtattccagcctgggtgacagaatgagaccctgtctcaaaaaaaataaataaataaataaaaaagaggggatttggataataaaataacttattgagatggtctaatattgttatgacttcttcttccatttaatcatttatttaggcattatttatcatgagcacatcaacatttgtatctgcccttttcttctttgttcgcttaatgttatcttttccagtttctcagaaggaaaaagaattaaatgaacctcacatgtgatttgaaaacagagatagtatccattccaggcctctgttttattttgctcttcccctctccttgacactttacttttgggcagatgtgcctgaggaagacttagtgtaagatgacacaaggtggaacagagcttagtttgtgagtctgagaagacttagtctaagatgatacaaggtggaacaaagcttagtttgtgagtctgaagcagaatcaggcagtgataagcagtgtgtttcctggaggatgataaactttctatatgatgaccttgttttatcgtggtattagtgagcatcaaaactattcactgacttatattcatatattttctcaagaggaggaaaatactgcatgggttttgcagccagtcttcctgttcagatttactctgcttaagtacttaatttaagagagagagagaggttgacaaaggattccgtaacttctagtcttcaaatgatcaaaactgaggacctggtgaaggtttcaggaaaccacttctttaattgattctctttccatgtaaaatgtatttcaaaggataatagcctacgatttgactccaaagcttcagcgtagaagaggaattcttctggctgaactatatagctaatgctcaattaccttagcttctattgaaccgtattctaaacaccttcctttgtaaccatcaccttgtgcagaagtctgtatttttagcctttaagcagagctcaagtgctgtatttagacatctgacttgaagactaaaatttgctcagtgagcagaacaaatgttcagaaaataacatttcaaggttagagttagtgtcctgaataaaatcccttttcttctttttctccgtattgaatataacataaataatgtaccctgactgacttttaagattaaaaatcagagaatacagtgaacttggaaagggaagagaacataattaaaaattgaaggggcttctgttgaacaattgtttgcctgaaactaagtacacgttttattcttgactcaataggattatggatcttaaaaggatttttaaaactatatagtaaagcgtttagaaaaagggcctgaataagcctgcagctactgtaagaaatattgaaagaaacacacacactcacagaatcatcataatatccttcttagtatgaggaggaaaaaactaaatactgtttattgctagtagttacagtaattgtatttaccaggttttgactgtctacaatgtgttagtcactgtgcaaggccctatatataataaaccttatttaatattcacagcaattctatggaataggtattataaatcccgttttgtaaatgagaaataaagtccagaaagtttaataacattcttaagattatatagttagtaaatggaagtatattgtgaatatttctcaagaaaatctcaaaatggtgcccaagactccctgtccttgagaaataaaaacattttacttcttaggggaaatagatgagagtgatacgttgtgattattattcttaaacaagacaatgcaaggtcccgggacccttttttgaaagggaaatgacatatttgcactgagggaaagtgattatcacttgctgagcatttccttaagaattctgctcacttggattatgtgtaatttggtgaagaatttatccccatgtattccatgaggcaaaaggatgttgcaattgaacttcacagtgcatccataccaatccaccgggggaaaaataataaatgagtctgggtactcccttctcttggccacatggttgatgttgtagtcttcactctatacagccagtcaccttgtgaacagaactagctagagcccaggactatttgattgattaaagattcccacccttaaaattaggactgaaagacatgttagaaattctgaatatgttttaggccctgcatttgaaaggtaataaatagggtatgtgaaactctttgacctttttctggttctcagtgccttgaaatttctatctcaattttgtagatactcaacactctaacccagcaaggggagatatttcatagtggggcatagtaataatataagaagagtgtattagtctgttttcacactgctagaaagaactacttgagactgggcaatttaggaagaaaagaggtttcattgactcacattctgaaggctcaacaggaagcgtgactgggaggcctcaggaaacttacaatcatggtggaaggcaaagaggaaacaggcagcttcttcacatggtggcaggagggagcaaagggggaagtgccacacactttcaaacaaccagatcttctgagaactcactcacaatcaagagaacagcttgggggaagtccacccccataatccaatcacctctcaccaggcccctccaccaatatgtgaggattacaatttgagatgagatttaggtggggacacagagccaaaccatatcaaagagactgagtaaagcaaaggtgaattagagatttattttaaatgtagtggaataccaagtttatgtaaagcagaaagtttaacagtggtatggctattatttggtgaactgattatcattcttttttgcataataggttgtgagtacccgtggcccaatggtatcttaattcttcatttgaaattctaaaggtttgcatttcatttttgttaagcatgttgcattactctaaaacagattttaaaagaaagatactgaaatataattccatatagttactgagtcattgactttttcagaactcttttaggtaatcacccttatttatagatgggaaacattcagctgcagaattaaatgatttgctcaaaaggaaacaggaataaatggcagaatcaaccacctaatactttggatttttggaaagtattaaaaataaacaaatcagaacaacaaagttctccatttctttgtttgtggagtattctcccctctggccccagcaaaagaaaaagttagaaaggagatcctctggaagttaaaccaatgtgtttaaggttaaaccctgcctcatgtcacttgtacaatttacacaacattcatttccttaagtgctaccataattttgtgaatgttaacataaagaagtccaggaggccaccaaattgttcccattggcttttttgtgtagtgtaggataatgaggcaatttttgctttgtctatatatattttgtgtattacttgattttatgatcatatattgtttgtgtgactttacctttaaagtcaatagaattataaatttaatttggtatttacaacacacatatgcacacacatatgtatatattttttcatcaaacattaggcaaatgatggttacatgaaacatgaaactctgggactacttctgtttcacaggttcagatcctgtgtcctgacttttggttgagaaaatataggctcagttaatgtattcagttgtgtgcttttacccaattttccattatctcctatttcatcttccaccaaagtaacttcagacaagaaaagtgtgtttgaagactaccacgggttaactgcctgtattccattataaaatctttgtatatcgtgttagtctttggttttgtggtcaggatcgactataatgaattctggttcttgatttaccaaatgtgagaacttggccgatttatctaatctttgggtaaattagtctccccatgtgtaaattaggaatgagaaaacttaacctttagggttgttgtgagaactaaaagagctccagtttgtccagtgcttggttttatagggactagatacaggtagatttctttcttcttcatttgatttaaatccaacactcactcttactgttgtcccaggtaaaattttaaaaattcattttgctataagtcagacatgattttcagcactctgatttaaaaagtaatgtgatttcttgtggaataactaaaataaggacccaatgacagttgtttccacattaaagttgggtggatttcacctaaagcttctgaattgccagacaagcttcactttatcaaggagaaaaattaaaatccactaaaccaaagtaaaatgaactaaaattccagaagctaaaggacaagtaaaggacacagtcttcacactctgggcttttcttttggtgttctttccattgactgtgggataaaatttgggggaaattgtgagggtgtgaatggcaagtgtatgtttgggttctaagacttgggtcattaataccaagtcataatgtatatttttctatcccctttcttactcagtattgttcattttttagtgttattcagtattttcagtatcatgatttgtagaaatttttataataatgacataattataccataatttcttttactattttccttatattgggaatatacaccatttgcagttattcagtgacactttaaagtagcagtgtgatggacattcatttacataaatcactatccacatccttgattttttttcttttgaaatgattcctagaaatagaatcactcttaaggagtgtgaacgttttaaaagattcttgatatagtgtgacatttttttccctgggaaaggtgtaccaatttacactcctaccagcagtgtttttcacatcatgtgcttgtcattatctattagcatcaatgatatatgaaaatgttaatgtttcataatttacatttacttgcttaccagtgaagttgagtgttatgtcttatgtttactagagaagacaggcacactggaatgctccttcttttcagcaagtacatatttagacactttgtgttccagtggtagtttttctcatttatttgaatatatgtcaataagcaaaatcttggctaaaaataatcaccttagcactaaatttagtcaagtgtcaaaggcattttaaagagactaaatttgggatgcatctcagaaaaacatactgcatgatactatgctaatgagattttctttttatgctgggcaactggtaattttgttgttcaccctgagttccccaacaatgttgaactagcaattttcaaacctgtaaacatttgcttttgtagtcaaaattgaaagatacaattgaaaggaaagatttagttcacaaactgtataatcttctgattctgcagaattgaaatgaataaacttgaacacatatttaagaactcaagctctagtcagcatataacttaagagggaaaaggttgaatttcctttcaaaataagcaccgtgcatgaccatgcttcctaagaaaaaaagaaaaggtaatatctctaaaaattgtatcatcattattttcataccagttaccatggttcaattagtccctctctatccagtctagtggtacatttttctaaattgtgaaaattcaataataattacatatatagtaatatgtatttatataatattatataatatgtaaaataataattatagtttatataaatgtgtgttttaagtggtcttattatgtatgatatttcaaggtgtaagcttatttttcaggatattgtgttttggtacctaggaggatcagctttgaatcatttctagttacatatttctaatttgggggaaaatcagtttttataggaataaaatgtggtccaagtctttagcagagtgaaggataagactgaattataaaaagagaggtttaataaagtattttttaagccttagaggaagttaataaaataattttattgaattccatcatgactcatcttctaatattaattttgtaaataggaaaaaggtaattaaattactaaagcaccttcattttaaaggttaactttattattattgctcataggaaagtttattttttaccacttttagaacactaggtctttttaaattgatgcacaattcatttgggtgctttctatgacacgcagtcagacttgcctccttcctgtgtgggctctgactatctaataaaagagataatgtaatgacttacatatctagaacacaaggtaatgattccattaccaggcatatccctgttctgatttgcagacagtttaatttttacatctgatctttaactagtgcttcagatgaagcagaactgggtatttgaaaggaatttaatttgttttgcccattttaatggtagttttttctgagtgtatttaaagagctttttataactaccatcttccaatttttaaaatggaaatatattttctattgcttatttttttttactgcaaagccttatttgtttattttagaaaaattagaaaatactgcaaagaaaaaagaaaaatgaaaaaataatatattcttagagaattctcattaacatgttggcagatactccagtttattctatataattcctatatacaataggggatcaaagtacttgttacactgaataccatactctgacattacatattttgtaaatgttgttatatgtttttgattgagcaaccagtaatcatgttagcctgaagacaaactttgcatagttcaaagagtgtttgccaactcttttttaaaaaggaggtttcacataaaaatccagatgtccaccttctcttgatagatggggattctgtgctgctggggctcagaatcctggttggccacagttgagagcagatggccacagttggccttagccagccagagcatgcactctgcattcagcgcattcctgccctggtctccttcacatcttgatgtgcctacctgactcccaaagccagctgtttgaagggtagtagtttgtctagggtagtgcttttcaatgaggctgtactggcccctaagggaagactggaaagtgttttctggatgccgcaatgcttggagagcactactggcatttagtggactgcagtcctgttatgtgagaggactggacccggaagttgtgtcctgcattttcaacaatccctttgggtagtcatataggtgaaacacctgtttataattatttgagcctggaaacaaaactggttgcacatataaaaattgctttaattcaattttagtatacgttgaatttcctaagactacagctactgtataatttcaggtaaaattgttctttgctttggaaggtttactgtgcattgttcaccatttggaaaaccatgttgctgacaacaaggtggctcatggtatttgaataaccaacacagtgcagctccatcagtgctcatttgtagcacccttgttcaatacaacaaaaagcaaaattaacactcctttaacattttttatgaataagaaataaatatcagatcttatgagagaatattaattcttctttgtgtgttctttacttttaccatctataatttgccttggcatgttatctagacttcagttactcttattttccttttatcacttgcctgtaagcctgctttattgtttcttattctaatactaaattttagcctaatgtccatgtaaccactcaaccctccagtctttcactttcttactcttcttgaaaaagtactggctgcttattacttctctttaattcatatttacttgttggtagtagggcaggcatcagatgacttcctcaatatgtaagttatgttcatgcctggagcactttatgattaaaaagaatattatgtatagaggttgtttgtataaactatgagctttgtgttaggttagtaaaagcggcattacaaaatacttgtttttaaaagtgaagctttgtgcttgagcagcttaatgctctaggtgaccatcgagaatatacattggtcctaaagaggcttacaggcttctagaaagacattacatagaaataagttatgcctagactgagaggatgatgaaatatgctccaggatttcagagaggggcaagtaggtgtgtttgaatggatgaggaaggcctgtggatgaagccgaggaggtgccaccaaacctagatgcttggggaagctgttaagagttttggagaaggggacaatgaagcaaagttctctccctttctttttcacttccccctcttctttttcttctagaactgtgtcttttcttctttctttcctgaagatgcaaaagccacagatgtaagtgagagggactaaagccagagtcatgactatgaagtattgatttcaggtgtttgttctcaccttaaactcagaccaaatataaaaatatgaccttgggggcttagaattgtgcagtttttgttcttcaagagaaactattggagagatctcagagcaaggcattgcttgtatttcccttcagtgtagtacttagattttcattttcttagatctaattataaaagagacttaggaggtggaaaataaattcaataagtcttcaaagtttttcctttctttattttataagctaagtatcactgcattgggggtatactaagaagggtatcaatgacagaattgctagtttcctcaacctgcctcagcttaccaaatttaactctttttgtgaaactattaccacatgtaaatatattttaaaaattagaatttctttgaagaaacattttcctagccaatcaaaagcaagagctagtgaggcttcaggatgatttggttttcagactttttttttctaatgccacaatccttagatatggtgggaaaggcacttcaaagtgagtactccagatttaattcaaatgcacccatttaagtagctcagaaaattgcatcatctagggttctggagtgacagtgttttatatgttgaaatcttttggagtgggattgaaacagcaaaatcattttatttcattaaaatcggtctcagcctcttctttttcctctcattcaccgcaggcctttccatctaagaaacaattcatagctgcttcttcagaggatgtctaattttccctcattcagagggacacatttggtactttgccctgtgttttaattagtaagcttcagagaaagaaagtcgtcagagccagggcccccagttgtggaagtttctatatccggtaaattggatccattccagggcagaatcatttatcaacaaatgaaacaccagccacttcccacacgtcctctgattgcattaaaaaatcactccccttcctacccaaattgagtatacttagagtatggagctgacaaacattctctttccttctcctcctcctcctcctcattctgttgaattgctggtttctgtagtctattaggcttcttattaatagtaataaaatgttcattcattaactctctcatgcctgcataccagctatagtaactgtctttgcccccaagttatgcagtctttataaagtcgttcagtagcagggcaatgagttgggaaaactgatattgcatctgtagcatcaggtactatttaaccagtgggagggactgataaaattagcaagttgactaaccacttcccttccttgtggctctttaatattataacggatacagaaaagttcagaaggactgagctagtttgcgaaaccacagcacactttggcaaagagggaatgcacaacaaaacgggtaagtttctttattttaatcttttaagagaactgtgaaaaagatagtggggtagatgtttttaagtctgactctgcaaatcgtctttaataacttgtaggctgtggaaagataaacttgtcatgcggagggaagcaaaaggttttccaatcagtaacagtagcaacaacaacaacaaaaattacattgagcaaaaaattcaactctgagaatgcctttattatttcagatagacaagactaaagtattttggggagagggttcttgaattaggaaaaatattgatgaataagttcctgtactctgattttttgaaatttagcccggaattgtcagcaggggcattatctactgaagctgaatgtccgcctagatcctgaaacagcttagtcttctgttgtcttctttgtggttgaaaatgtttgttgcttttaactccttgattatcaaaaatttcaaacacaagcaaaaatagagtgaatagtatagagatttcccatgcatctatcacatagcttcaacagctatgacttcagagcccaggttgtgtaatccacacctctgtggtacactccctccttcaatctagttgaattgcagcattttgaaatatgcctattgtgaacattaaataaaagaggcctaaagtttcctaaaggctcataccagctcagcaatataaagtttagagaaatattattacataaaattgaattatgagtcatagaaagcacaagtgagtttccactggttgttttaccagtgggagcaggagtagaggatagtagatattaagactgtagtctctggagccaaactgtttggggtcaaatttggttctgtcacaatccagtatccttaagaaaatttcttaacctttctgtgtctcagtttcctcacctaaaaatgaatacaatagcactgatctcctgagcatgagggatgatgaaccagtgcatgccaagactcagaaaattgctgggaacatagagtgctcactgtttgttagccctacaactgttggtcaaaattattagagtgatggtagggttgtgatttgtccaagcagaaagccaaaggttgtatctgagcatattgggctgtcttctgaccattgcttttctcctgattattttataatgccaggctaggaaaagtctccattgagatatcttgcttgcttttgcaccctgggaaaactccttgctcttgctttcccccaccagctctgaattaattctctctacaaacaaaagttatctgaggttgtcttgcccaccctctcactttgaggatgagggagtagagattggtctaagctcacagagcaaggagtagatctaatggaaaagaccctgtcatgggcttcatggactcctctaatgtctgtttggaggggcgctgcagttgggtttaggcaacactgttgggccttagaggctgcctcatatctgagctcttatgcatccatctctgatgtagaggtcttccagggctgcaagttgctcagatacttttttcattgctaatgagaatggtgaaattctgaggatggcaacaaatggatggtgaggaccttccctaagctattttttttctatactatagtaatggctgtcatttattgagcatttacaatgcacctggcactgtgctatgtggttttcttatttaatcctccctatatccctatataatacttaatattaatatcttcattttatagaaaaggaaactaaggtgcagagaagctaagctacttacccagctcataagggacagccaggattttgttccaagtctgtctgacttcttagagcgtttgtccacaagaaataggtttgttcaaacatgtgcactcgaaatgcatccgtggttttgctcttaggcttcctgaagatgaaagtcgtcagtattcctataaagcaagctgaatggaaaaccttttctctagtaatagttttcccacagtgtattttcagaatgcctaattacaagctggaaatttgtcataaattttgacaaatacagaggcgggtggggatggtgtggagttaccgctgtaaaaagtaaatattgaactgacaggtaaaaaaaaagaaatgctcttttagtaaattaaccatgcttcagtggtggattttgtttttaaggccatttgtctctcttgagtttttgtagaggagggtgaaatatatctaagtcagtttttgagaacatggagtgctgttgtaaaacaaatgataaacattgatgcgctgcagaaataaaaattggctgaatcttctgggaggtgctgaagagaactgggacatgcacagtcagacattttagaaacctggaattgacttgaagtgctttatcttttacattacgggtacaactgcaaaaatagaactgaatgtgtgaatgaagagagaggttaatttcacaactttggagttttttttcccctccaatagagtaatggtgttttaaatttttttttttcttcactcaaggggacatggtctaaaatttagagctaaaaatgcaaacatcagacataaatgattgacttgccttttatcaggcaatctgatacaatttgcaatcgttcatttttccttcgttggctacagtacttttgtcatcttgacagaatcagccaagctttacctataaaaatattggaagagatttgaaatcatatgatctttttgcagaaaaagaaaaggataaagggaattgcagctgccagtgttggggggagtgaagtgggaagggtcactgttatgtcacattcttagattcttttttttttttattatactttaagtttaagggtacatgtgcacaacgtgcaggtttgttatatatggaacccatcattctcagcaaactatcgcaaggacaaaaaaccaaacaccgcatattctcactgataggtgggaattgaacaatgagaacacatggacacaggaaggggaacatcacacaccgggcattcttagattcttaaacctttgagaaagcagagcagctctttagtactggccactgcaaaccatcttccagaattgttccatcatcttggtttttttctttttctttttgtctctaatgtcttcatctcataagaacatattcacaacctgtaaagcatggtttagggtcggaaatttctgtatttgtctgtcattagagacagattcagagtgccatttagcttgtcagtgtccacttctttgtgcagtaatgtaatttctggtggggttggtcacccacgggattactgcgtactagtgccttcatgtttacagattgttttctatcctgatctttaacatttgtcaatgcattatgtcactgctattattaaatgtaaacatttaataagttttaaaaatcaataaacattagtgcttgatttaaatgcttgatttaattattaacttaataatcaatttaaattttaataataaaatgtattaaaagtcttgaatagataaagcattgttttcccttgagatgaattctgtcttcatttgttcttttgtccatttattcacaattgcttagcatctcctgctggagatccagaaatcaataatcacagtttgtgccctcagaaaattcacaggtttggggtgaaaaagagttgtatgaaataagtgatgctatagttcacaaaatatattctaactacattgtactgtctacattgggagagagggtgtgtgtgtatggataatcccagaccctgggattagagaatcatggttcaaagcccattaccctctggttttgggtatttaactaatgttcttattccgtggtttcttcacctgtaaaatgatactgagctgctaggggtgttgtattaatttaacatgtgatacatgttaagtatttatatagcgtatcctatagtctttgggggatcaaggatagtttctcaaatgaagttaactttaaacaacctgaatggcatagatgcttctagtcacagggaactggatatgacaaaatggaaaatagttttgcctctttgagaaagagagtaaaggtcagcatggctgaaacatgtaaaaagtggggaagttgcttagaggtactggcagaatccagatcgtgctgggcctagtaggtcatgttatgcagctgcatgttgtgcaagtgcaatcagaagtgattgaaaggtttacacggggagttgcatgacctgaataatatttttaaactagttgcagagtggagaatagattcgtgaagagcaagagtagacacatggaaataggttagaaaactatttcaatagcttagtccaaaaatgatggccacttggattaaacagtgtcaggggtgtaggggcagtggacagagtgagaaatactgtataattaataggacttggtaaacaattggatgtcattggggagcatcaattatgatcctatggtgtttagcaactgggtctagtgagacgtcttgtgtgaagatgggcaaattggaaaaagcaggcttggacttctcaatttacatgcttttgaaacattcaagggaagatgtcaagtaggcataagatgtcatgtagatgttaactgaagccatggaaatagatgtgatcactcagagagatgggatgaagtgagaaaagctgagggcccagtacttaaccactggaaattccaaaatttagaagacagaggagaagcagccagtaaaggaggtggataagtcatggtcagagaaaagggaaaacaagaaagttgtagtttttaaggaaaacaaaagaaaatagcatattcaggagaaaggagtgattatccatgtcaaatgctaaggagctaataaataatcaaaaaataccatggaattggtatcatggagctcattgacataaagtaaacaggcagaaaatataatttctttaaaattgcattgcattttaacatactgactaatcagttttactgttgactaattgaataaatatatgaagacaataaaagagacatattattttcccaagtggcagtatatttagaaattatcttacttctatctttacataactgtatggtatacaaggaagcagtaataaactatgctggtctaaacttacttccttggaagtgcaaaagtacttgaaatcagcactttcttcttgtgtattcccaatatcaagattaccaggtaccattgctgagggaaccatttgcgtagaccagtagttctcaaccgggggcagtttggtaccccagagcacatttggcaatgtctagagatatttttgattattacagctggcagcaggtaatgtagggggcagcatctagggggaagaggccagggatgctgctgaatatcctataatgcaccagacaaccccccacaacaaagaattatttggccccaaatgtcaatggctgagaaaccttgacatagactaatgcagacctgctcagtgccttggcaatagtagatcttcactagaatttttctgcaggagagtgggagatcctttactgcctttttttcatggtctaccagtaggtttgtgtagtaagtgatctttgaatttggtttttatcttgaaacttctttgtaaaaaacaacgtgaataaataaaagtattgtgtactcacgtgaattacctctgcagaattttcaatagaatttatttatgtggttaaaaatagaggacagtgctccacccagtgcatgttagacttcttacagcagaactggcttccttatgcaaagttagttcctatgctgaagtgcattttagagaagtttcagtattaaaacatactttaaacatttaatagattaattttctttaaacctgtaaagatctacgtctttaaaaataataaattttattttctcttgattataacataattcatatagctcatatttgtgtgtgtgtgtgtgtgtgtaactataataaactcttagatacctataactaacgcaggatatggaatttaaccattatcaataaaacctcctttgtgaattcccctcttggccaaggagaaacacaattctaaatattttgtttcttgtttccttgtgttaaaattctactacatatgtatgtatccccaaacgaagtatgaaattagtttttaaaatgtctatgcctgtaggatggattggaaaggagagccatggaaaaaataaaacaaactcaatggctatttgagaaatgcagacacatggctttgaggcttggcaccaagcgcgggggcagtggcaccattagaaagaagtagacatttctgtgactgtctgcctctgtggagaaagggggagcctaaggtcaagatgacagtggtttaaacacagtgttagaatggaggttttatgaacagaatcacagaaggaggcaggggacaagaagcacacaggctgagacagactttgtatgcggtgccttctttcaggaagattgaagtgccatgtttattgtctagacttgtacttgccatggaagcaggacatctgagagcttgctctgtctgggcaattcaagatagagacttagagacgtcattgttgagcagtagagctggaggtgaagatttgagaaacttccgtgtaggtacgagttgaagccacatgaaaggaagaaacctggggacaaaaagcttagggaatgcccatagctaatggtggtatttaaaacacattataagcttttgctgtggcttttgcttatttttatttaaaaacttttttatttaaaaaacttttaattaaaaactgttttatgtccacgtataggcttcctcgggctgtctttacaatatatgttatggtaggggattattaggctggcacaaaagtaattgtggtttttgccattaaacggagtggaccaaagaattttgcaccaattctttggtccatgtgtctgcatttctcagatagctgttgagtttgttttatttttctgactgctctccttgccaatccatcctacaggcatagacatttaaaaactcaaatttcataccttgtttggggatacataaatacatagtggaattttaacaacatgttaaatgtttgaatgctacaataacattctaaactaggttagattcttgtgacagtaaataggatgttatggtttggcttggaattcttgtaagacttggcacagtttttagtcctgatccaaaggagtttagtcatcagaagaaccaccagtggcacagtaaatgtcagtgctaggtaaaaatgtgacatcaacaaagtttgtttctagggctgccattctcctttttgttagtttctttggtcctacatttcttcatcttcacaataagaagttggtctggataatgtgtcaaatcattgcaaaaatgttctatgctttttagccttaatgacgttccatcctgcctaaggcctgtgcctgggggatttcactctgccctttcttctctcacaggccatttaaatgttacagctctaaattcgtttttctcagagtcctgctacttactaatgctaatgtgtcaagtctgtattatttccagtaattcacaatacactatgattggcctaatatattcactcccagatggcttcttcactgggggtttcactgcctgaacctaaagtggtgctcaatggtagcatggcagaggtaagctaaacagggtgatattgttattatttattttcacaagtacttttctgatccatatttatctaacctttataaacataacattagaaatgtaagacctacatttttatgttttttttttttttttttattatactttaagttttagggtacatgtgcacattgtgcaggttagttacatatgtgtacatgtgccatgctggtgcgctacacccagtaactcgtcatctagcattaggtatatcttccaatgctatccctccccgctccccaccccaccacagtccccagagtgtgatattccccttcctgtgtccatgtgatctcattgttcaattcccacctatgagtgagaatatgcggtgtttggttttttgttcttatgatagtttactgagaatgatgatttccaatttcatccatgtccctacaaaggacatgaactcatcaattcttacttgagataattttcaaaagtttttactttccagtcaatgaactttctttgtttagcttgtatttgaattgactgttcttaagtcaatttttatgtgacagtgttgctacataggacactcttagtcatatagctatagctgtgagttggtttaaatatcccatataaaaagttataaaaacaaatagtaaagctgttattatgaatttacctataggaaaactgaaattttattaaaagtttcatatcagcattttgtgattttgtaacaacaccgtgaacgaaaacccagtaagtaggagggaaagtgttctgtatttatagttaggattgtatctgttagattcaaaatgatgagttagattttaaacttattttggagcccaactattcttgagtttccaaatgaataaagatatttatataataaaaattcagtttattgttgaaaaatgaattaagatgacagtaaataacctcaggtgtaggactctgcattgtaaagtggtacatttaatgtttatgcaagagtaagatttttttaaaaatttattttaaaaagtgattagcaccttggctgtacaactcttaagatttttttttttttttttgcaacactgcataaaatttgaagtattttttgcttcaaaatttgacctacttagaaaagttctgataattccaacgtaatatattccttgttttgtaagcgcctttgggtaatgtattggagagacaagtaatctcatcaagaagcgtaatggaccctatcacatttcaagatatattttttttcctagcacttctgcttcaaatttagtctgtgtttaatgataccacactttactggcgagggtacttttccagcagtttaactctctttgcatacaaatggtgttttgggtctggctgccattactgatcttttccttgaaatgaggtgacataatttgattttttacagtcaggaaaaaaaggtttagttcaccttgagaggttagagaaagaaaggttatcattgaatgaaatgcatggcttgatgccatttgtaaaacaggttggtgctggctcaagaaggcaggaacaaattctaacttggttgaaaagtatgattggcggaggggtaaaggaaaatctccagaattagtcattcaggggctctgcaatgtagatctgaagcagtgcggagaaaaggctaccaatccaccttcatcttagcaagcaagcactgttcctcttcttgattccagggagctacgtattttagtcaaagatgttaaattttgaaggcttctcaagagactgtcatgacaagcaagatattctttattatctccttttgttaatgaagcagttgaggtcctaagagacattaagtgactttcccaggaactcagataccaccaccctaaaattcaggtcttcctccccttacagcagcctctctctagatcaagcttgtccaacctgtggcctgcgggccatgtgcagcccagggtggctttgaatgcagcccaacacaaatttgtaaactttcctaaaacattatgagatttttttgcaaattttttttttttttttagctcatcggctatcattagtgttagtgcattttatgtgtggcccaagacagttcttccagtccgtggcccagagaagccaaaagattggacgctcctgctctagatatactgacttttccaaggaatgacaggggttaagatccgtttttaattggttccactcctggtggaaggctttcttctatacatgtcaggttttctttgacttatcaataccttcatgaagaaacaatgaagtgaaggacattttaaaagcaggttgtataagccactaaaaaattttgaataatgcctagtctctgcatataagtaaaaaaaaaaagcagtttaacaatatgttaattatatgtagacattatttttatcacaataaaattaagacatactacaagaacagattgacttagtttttcagtttgcaattatcttcccagttaaatataagtaaagatcttaataaatgtaacattaaagttcttgaactatataccacacaccattccacataaacagaccggttatattaaaactagcaaagccgtattttgtctgtgcttgctagaaaataaattttgcatatattctagaagacaaagatgattttgtatatgtaattgacaaaaaatacttctaggaaaaatataattattgtattaaaggttatgaaatggcagttgaaacccctaaagtcatggattctagttaatacagtataataagggagagctcacactattcctcatgaatcatgctgagaaaactcctgtcaaataaagaattattaagttgagttaaagaaattaatttgtttcttcaaaactgaagttaagaaatgcaaacatttttttctctggatgaaaacactgtttttttttcccgcaatgcaattttataaataaaaggtttattgcaaatgtattttgatgaccttattatactcattttgtgtgaaattatttaaaaaataatattccctcaagttaaattgctcaattgaaacttctcgcttctcaatataagcatcagaataatactttaaggtcataatatcagaagctattgactaagtgatttaaagatagaatgtctgtattctcagatggagcaaattaatttaaatatggtagttgaagttgcattttatgatagagcaggacattgttgtcgtgttttttaaccttaacctgaaaataattagaggaaaaagcaatctagatacattatagatttttttttattgcataaagtgatttaatcctctgttttattccagagacttatttaggtttcatttactgtcccactgggatagtagatagcataatactttctttcttattactatctaagtatttaaatgcagaaatggagatgaaaactttgactcctactgcatttgaatgtatgaatttacatatataaaaatgtacaataagcatgtgtatagaaaaaatcagttatattttttgtagctcttgctacagagaccaagagatcaaaataaatctgccctcaaatgagaagtgccagcttcttcgcttcccatttctcccaccagacactcatgtttaataatgagaatgaatgaatgatgcagtggataaaggtctgtcttgttaattagatgttctcagataatgaagtcttaatacacctgtgttttctatattccctctaaatcaccatagaattcaagaaaatggatcttgtataaatcttcagatctatttatttttgtgcatatgcatttgaccaagtaatttatttaaatgatttaaatgttcaatgactctactgcttttgaagtcatatgtgtggttcttaaaaatttaaaatactcaggtgttaagaacagcagccttaccatcagttggtgatttccttaagtgaaaattgaagagtttaagggtgcaagtcatacagcaattaagtagaaaatgtacatgtgattaataataattccagtctacttgtttgtttgcactcttgggtcagtgctagtaatcttacacacttaattgacacttgtgacatatgcccatatgcttagttctctaattgtggttctgaaggggacttacttggcatatgtagtttatatgcatcatctcagtcagaaaatgggaaggaatccagatgatgatacgaagtatgcaatgttatcctttggtgaagacattgttattgtgtatggtgtggctggatatgagggttgaggtgtcaaagaagggcgttagtcttggagccaggaagatctggatttttacataagcatattattagctacctcagtgatatttgcaaactaactttacctttccaagtctcagtttcttcatccataatgccttctttgtgaggtggtagtaaactaaaaggaaaaaatttatgtaaagtttgaacctactttctagaagacgtgaacaaattgactttgccttcatttgtttcagtttcttcatctaaatgtctagtctgtaaggcagtaggaattgtatgatgaagtcattctgtaaagctagaaacaaaccttctagaaggcatagacagtgtctagtctatagtacagtgtttggggcctagggagtgctcagtagtcatttgagtgactttaggcacttaggatactgacagatattaaacaaatattatttctgtgatcttctttttccagagttctttaactggttgaattactagttaacaatagttaatcatctcagttaagtaactttttccttcaggtcttattttgtacatatataatatataatataaagtgttgtttgtcaattgtttttttttatgacttttcctaaaaacatgattttactggatgcagtagcataaagaagccattaaaatattgatagtttttcatagaaagggtagaacaccagttaatataaagattaagtgtatagtaaattcaccccacctgtattatggtcaagtcactagcataaagctattaagttttcagagatggcaaatgggtagttatggaataagactcttttttttttgagacggagtcttgctctgtcgcccaggcaggagtttagtggcgcgatctcggctcactgcaagctccgcctcccgggttcctgcctcagccttccgagtggctgggactacaggcacccaccgccacgcccagccaatttgtgtgtgtgtgtgtgtgtgtgtgtgtgtgtgtgtgtgtgtgtgtgtgtttttagtagagatggggtttcaccgtgttagccaggatggtctcgatatcctgaccttgtgatctgcccacctcgggctcccaaagtgctgggattaaaggcttgaaccaccgcgcccggccggaatgagactcttacatttacgttgaaaagcataggtgctggagtccatggtaagattattagctgactaccaaatttcattccttctttttccatggaaacagtgcctaagcacgtggctggccagctaggcactatgacttccagttcccatttgagataggtgtggccatgtggctgagttcttatgaatagaatgtgagtgatttggcaatttgtgtcacttctggatctgtgctttaagatgttagttaggctccatgttccttccccgttctgctggctggaacctcacatggttttggtccagtgtcaaccttctgctgtagcagtgttctagaaatgtcagggcagcaaggtggaaagaaccttggttgctgaggtcctgccaacctgaagtgttacacaagaaagaaacttctctgttgtttacaacactgtattaattggtttctttgttacagcagcttagtataaaccctgcttgatagagagtcccatagaatttcgttgacctgggctctgcccagcattagcaaagtgttttgaatctccaagccccaggttcctcctgtgttacatggtactattgtgagattatactatataagagtttaaaagttcagcatttaaatataccagggactgtactaagtgccttctatacactgtcatttaatgttcatgactaagttatgaactagaaattatctggattttatggatgggagctttgaggaatgatgagtgtaaattactttcccaaaggtttagagctggtactgatagagccaggtttttaaaaagctcagactaccagacttcagagctcatactctcaagcaataccagtagctcttagcaaagtctttggaaaatattaagcattccataagtgctaatagtattattaattcttagcaagcatcatggagcccctgttataggtaaagtaatgtgggttgtgttttggggaccctcaggctatttagcaggggacacagatgtatagaaaagtcatcagagtacatgtactgcatgaaagttgaaaaaaagtaggttctctttgacaaaaaagtaatagagatcagtgaatctcagaaactagatcacctaccatgcaatcacaaaatatgccatattctacactgttgatattaaattaatatttaaggtccatacatcactttttaatgggggcagagtgcgtaagccatttttacgtattccaagacttaagaatatgtcttgtgatttctctaagagaaattctccagcagatcagaaggatagaaccctcagtggaaaatgtatgaaaatgatccatgctgccctggacgttcacatatgcccccacccccacctctgctgtccccaactagtgaatccttcctaacacatccagatgccatggtccctgattttattggaatagggtaaaaagtttaagaactggaaattctaaattgtgtttctttataggataagaaatcagttttttgctcacacactcttccttcagggcaggaagaccttctctgacccaccaatctgggtagcacctttccctcctggttattctcttttccagaattctgtatatttcctccatagcccactttttataattgtaatgtttgtgtttgtttttactggcacactgtgtatctttttccatcttcactcttgatgataagtgccacaatagcaaaaatcgtataccctccaccaaccagtgcatgtagatatcctaggccggtgcctgacacatagcaggttctcaataaacagtcatcaaatatgaaaatacatgaataatattaggtttgagtaaaagaaaaagaaatattgttagtttccccactttctcgactaattctgaaaaaggaaaatgaaaacatgttctggaatagtttgcttccactgaagctagaaatccacattcacatttgctggtcctttcaccttcttccactgtaccaacccatatgtgtccaaagaaacataactcaaagctaaataaagcatgactccccttttatcatcaggttttctggtctgtaagtcaaccagagaagtagtaatctagaactgtttgaatgacacatagttctgttgtacccttgtagagcacacaaagaaacaaagtttctgatctctgggcaggggtctaatagatgagaagacaagacatatgcatagcacaccatgtaatatagagtgagtaaagagtgcaggcagtaattgcttaagggtttaggaaaggaacttggtacagtggcctgggctgataaggtgaacttggaatgggttggtgaagggaagtacttcccaggttttgagggactaactggaacgaggaaggtaacctgagccaagatgagtgagctagaacaccaagatgtattttagtttgaatttattcccgccctcagcaattcactccccagtcctgagacatggaatgaagtgtaagttgtttatttgggaggagatcccaggaaactccaataggggaaatgaggcagggaatggaaggcagccaaaaaacaatatgttatcaagtaagttggtgtgctaggtaactaaagcttaattctgctggggaactctggaaatctctgtacaacaggcacacagggtgaggagctggggtatttcaataccaactcctgaacatcgttattagttgggggctgctgtgggtaggactcagactatgggtggggatgttaattcctcagcacttctggccactgaaaaatacatccaatcgttacagttagaagtcaatgtctggccagtgtgtactgcagtcgcaaaagcaaggagatatgggtggactgttgatagcatctgctatgatgtgttttcagaagtaaatctgagttttacccatgctccagaaatatgtttacatggttttgaagtagcagcctttgtaggaaagaaaagatgatagtaatctaagtttaattaagactgagtaatataggggtagtttggaattgaccaatagattctgaagccttctacacatacttttggtctctctccaagtggtgctattcgtgctgctggtaattacttttcttcaacgccttttgatccaggcattttcttgcttacgatctttggatggatattcatgctggcaggattaagtcttaactcctcagactttaagatttctacagttatttcaactgtttttcaagcttcatcaatattgctgaatataaattcttcactccaaccagacttatttactcacactcctttttgcttgtgctattttggatttgcgaaacaccccccacttacttaaattctttccattctccatgtctgtttccaaactccctcatgcagccatctcccctggtcatctgagccagcaggctgagatctcacttctctcgtggacctcattccacagttaacattgtgacatgtattctatctattaatgtgaagttaattttttcttatgttattaaatttattgtgtgtttatatcttggcccttcagctacaggagggcagttcttgtgtgtgtgtgtgtgtgtgtgtgtgtgtgtgtgtgtgtgtgtgtgtttgtataggaggaggcaagagtatcttttttaaagccatacctctcaagttcaaatcctggcttcctcatttatgagctttgagtccgtgggcaagtaattgacacctcaacaaccatgaacatttatacctgttaatccatgagtacaaagggagggcacataaatgaaagttctgacgtgtattagaaaggttctgaatatgagaatcatcttgaacacattgaattttgtgaaaataatggtaattgttcaagaccattataaaaaaattcatttcccccaaagttcttgttaccatgtcattttcacaaataaagtgcttgctctttcttagattctaaaactagtttctaacattataaaatcaaaattattgcctggtgccatggctcacgcttgcattcccagcactttgggagtgtgaggcgggcagatcacctgaggtcaggagttgtgggccaggctgaccaacatggtgaaaccctgcctctattaaaaatacaaaaattagccaggtatggtggtacatacatgtagccccagctactcgggaggctgagacaggagaatcccttgagcccaggaggcagaggttgcagtgagccaaaattgtgccgctgcactccagcctgggtgacagagtgagactctgtcccaaattttttttaaattgtaaaattgaaaaaaatcgtaattattattaaagtcatagtaatattttaaaaacaattatcacacattaacaaaacagccgatgtcactaacaccaaaggtcagggtgtggaatatatgcaccaatggttctccatctgactagatatactttccaggaaatgaaaatacttggaagcttttcaaaaagttctagaagaaaaaccatttctgatacctacaaatatacatgtatatgaaagtgttacaaatataaaaatacatgttttcaaactcaaatgtaattttaagaactttgccttaatttatattgccaagtagcttaaacattttaatagtgtcactgactgatgttgattgttaaagacttcatccaatttacgaagttggttttagcaatctatatgaactaggttaattaaaatgtgaaatttgcaaaaccaagcctacgtagaatacttttaaacatcagaagaaaataaatcactgttgtagccttgtttctttcatagttatataaatttgcttaaccatatacaagaaaagaacttttcttttgaggaaaaggtacactcgaactctgatctgtaattatttaagctttgggcacttcatagcctaatcatcatttgctgtaaatataccatactccctttcaaaatgatatttaatctgcatttagtacgtggtattggattttacatttcttaaagatatataaaagttttggtgtactcagtaggtgattgaagatgtgctacttcatggagaaaaatatattaggtgtgtctgacctggaaagaatgttctattaatctttttcttgtgtcagatttataacaaaaagaagtggaaactatattaagcaaggatataagttacatatatatatatgtgtgtacgtgtgtatatatatctgtaggatatgaaaagatgttagccattatattttctcttattcttgctgttctctaatttaaactcaaattctggggattcgtatgagtttttatgggtaaatactaagacaggaagatagggtttgttgaatgatcccttcttcagatccactttatgatgcaggctttacctgtgtgcatagatgtagaaacaggtccagaaacaccagggaacctgaacaaagtcacatggctggtgagaggagaattcgtgtcaactccaattcctttggagaatatatgcaaattatctgcttgtgtttgtggagatctctaagtcaatccatattacccacatttcaatgcataattgtgagtttactgagactttgaccagaagtattgtaaagctgagcttgttctatggcgtttgggaggagttgaaataaatcatttcaaggacaatgaaatgttcagcccaaggtacactcgtccttggtttaaacacccatttcctttaaggactttctaatgagaccttgtggattttccaaaaaatataccgtgccagtggcagcttattcaccttacttacatagttcgaggaactgcttgtttaaatttagatactgtctctgatgaaatgttttgacaaagtaataccagcttgatactatttaaaatattttgacagatgggaaaattgtttcagtctgagttgagcaatactttattgcagtattttgtgagttagaaaaaaaatggtaaaggtagcctcactgttccccaaaataacatccttccattctccctgaggagagaaaggcctctattcagtcatagattacagtatgtgtgctgagtatgttaagaattcacacagtttaaacaagagggaacatttggggactgtttccaaacagggaacatttattgttctataagcaaaccgaacctaaagaactttcgggaacatttgttgtggtagcatgttatcagagccttctcatgccgtgatgagattgttctcaattaataaaactaaatcactagattttaaaactgacttggatgaaaaaaaaagctcaaatttacctacttcaatatctagagttttaaaaaatatgctattataataaaaaatatttaaatatttcacattagttgcaaaggatgaaatccaggtggtccttgtttgtgatattaaacaaatgtgttgaagcaatgtggtagggcagtggtcctcaaagtgtgattcctggaccattagaaatgcaaattctaggctttctggttcagacactggtgcagcccagccatctagatttttaactcgtgttcctgatcattcagatgcacactttagcttgataagtgcccagatagtgtagagactttcaagctatcccaaggcctgccagattggaaagagggaggactgtggtgggggggtggggttggggggaatgatcaggaatggttcccaggcttccccatgtccatttcaactatgggaactttgattttctgttttacgtatcacagagttttatgttgggctctgtgactacacggttttgaaaaacactgggatagatatttctttggaggacgatataccatggcccagaaaatctttagagaataacagcatctctggctgtgttcacatcattttagcaatatgtgtgtcctgaaactgaatttggtcagtaaagtaagagttagcctgtgtgtcagtgacagcctcatgttaaccagtctcctaaggaacacatgtacaaatcagaaatgccagttgtatttttctaattacaatcagaggcataacaaaaaattatgcatacactcacgtttaacttctcctgatactcgcactgtgcacaagttaacatttagagttgggaatatcccaacaatcccttgtccagtgattgaattgtccatgataccaattcaggcctccacctttgatatatacctgcaggtgtgacatagacatcatacagcattgttaacttacagctatagaatcaggggaaagagaagttgacattttctacagatttttatcaacttgtacaaatccattacacacacacacacacacacacacacacacacacacacactctcttactaaattgctgagggccgctaaattcagtgtctttctgaaccatgttatacaaatctactctattatctctttcaaatttctatttctaaaaaaagttatatattattgatggttatttatatagatttttaatatcattaattaaattgtaataagatctttatgttaatgtaactttttgctcacatcaattttatattgatattatttgtttacctctcagttctggagagaggtgatgatgatgatgatgatgatgacaaaaataggttactgtttttataacaaggattctgcagttaacatttagaggtcttacacagtaccaaacagtgttctaagtattttatatttattaatactttttattcacacagcctacttatgacaaaagcctttaaccttttgaacataacccccaatgaaaaaattgagatttggtacatatatacttcctttatgtatatattgtatatgattaggaaaagaaataatgaatcaacttttattatatctaataacttgtgagtttttattcccttccattttattatgtttaatttcagttttaaaagtccagttgagattcagaaaattgatttcattactcacattaatagtcacagcctgcagaataaaaaattgtgctatcagatagataatattattatttatattttacagatgaggaaataggcacagagaggttaggttagttgcccaaatttacataatgagtggcaaatccgcagttcaaacttaggtagtctgtctccaaagccctcgctcatagtactatattctgtcttacctagtcagctccttcatattctactactgtcaaggagggatgaaccaaatggggaatgtttttctcccaaatatggggacaatatagtgacagcctcaaattttctaaatagaaggatttagagatgaaggaatggagactggctgtagactggcgttagagctacttttccatttgaaggcatccttttatttaggatgtgtgtttgttttaggaagtatttgtaaagaggctgatggagattactgtggggggaaatggcttttgccactgaaccaccctcttggcactaccacgggaaatttattttaaacaatctaaagaacagtaggtggaaaagatgtgtacccagattatgtggaccttcctggtgaatgaggagaggacaaagtgattgtagggcctattgtcctgactccttctagggcatacagttagaggtgcaggactgctaccatggctgcatatttttgaacacagacatattctttccctggtgcttttaaatgtgatttaaaaatatgtgtcagatgagcaggcacaaaatgcaaagataggagagccatacagtgaaaaatctatttctccatcttttccttggttgtctctcttttctctctctttcctagaaacaatcactgttgtctctttcttgtgtagccttccagaatgctatgctgtgtgtgtctgtgtgagtatctgtagtaaacattaaaatattactacacattttctgtgccttgaatttattcctcttattttatgtttcagattttgttccacatgtggaagtgccttgtgcctcctttttcactgctacatagtagttcattgtgtgggttttccaaaattaatttaacagatcctctgttagaagacattaggtaatttataatctcttgcaagcctgattattttaaatttaaattacacctagggttctgagtcctctatatggtcttttattcttagcagaagcttcacaactctctgggtcttcagcagggactgataaagatcaaattgttgaattaggtcaggtttgtgtcaggaagttgcttgatctcagttttcttagatggctatttttagcttgtgaacagtaatcatggtaagaaatctttgtatcttgccctagacaatcttctcttggaaaattaaagtggccccctttaaaagatttaagaaatgcaatttgctaacagtttaatgggtttattagggactttgagggtatatttctagaaggagaaatatttttgtttctctgaaagttctagctactttattctccatagcccttaaaaacttttcagatttgtcttcctataattcgtagagatttggaaaattagacataaggcacctgttttcttaaatgcatggttacctattcctttgtcctatcctttcaagacaattctgggaacagtttgttcagctttacgaagaaaacatttcttcatcacctgagttttcggtcacccatgaattctaagaatattttagctgatttcagggaaaaagtattcaatattagtgattgataattatatgaaaaatagaccagtaaagcaatcaagtggaaacttggtagaaatgtatagataagtgacctggtccattctgcatttttctgattcaattatatccacagtaactcagagataacaaaattggtgctatgtagcaaataatctgaagaaaataatgctataaattctttcagaagtgatttcagaatttaatattttcctgtcaggagatttatgacctgacactgagaattattaaggctcagatccaaatacttagttcattttctcttgctcagcatttagtaaagatgtggaacacactagtcagatactggttagtcaagctcggaattcaggatttcatatccttgtcaccatgtgtgaactttggaatatttggattttaatatatgcaaatgcttttataatgtgtgatgtgttaggtgaaaattattgcacacactaacaatttaatttaaaatgctactcttgaatattttataaaccactggaataataacatagccttaatgaatataaaactgtttcttcttcctttgttaaatcatgtgggctgcattctacttaatacactgcctcaatttatccttttgtgctaagattttaagttaaaatagaaaataaacaataaatcaagttggactgcaatcatgttcacttgggaaatttcacttagagacatttgatatatttttggagggatttcagggatctacattggttaagttgaatctgtaatttggttatacataaaattaaagttaatctaagtggacagaatcaatactcttgtgagtttaattagatggccagcttccaagcaagagattattctttttactatcctcctatcctctttccttaggcagcaaaataattcctttgccaaagtatgttggacagttccctggtgacaagttctatagaaactcatagctatgctgttagcaatgtgagacagaagggagggatatgtgggtgaggaggccattgtattctagagatagtaataagcctgccttatctccagatcatagcccagccaaagggatagtgtcccatttgcagaggatctgcagtcactgtttctaaaccaaacctataaaacaggatggtgtttctttcaggctgaaaaatcccaagacagaaaaacaggaaaagtcggggagataaattataaattagactggacttgcagtgtgagaatcctgctattaatagttacgtttgatatgagatgcctggaaatgtggcagtaaattggagtgaggttttatttcaggtaataactttccttttatctctgttggtgcattggcaagaaaatctagaagagttttaggaggactggatgctataaccttcattgttcttatatgttcagtgtcatacgcaggcttttacttattgaagagtaagttatttacagtgttttaagagtgagattttattctagctccgtgaaacaaaacaactgggttgagttgtcatggttgatattacagaaattatttgatgagtagatgcatttttagcaataaatttaaaataggtttagtaatatttaagctacatgattgtatttctaactttgtggctgtcttttaaataaatgaagtttgaaattcgtgttttatatttcagatttttattcttcatgttgcaccatcacaaataaatatgtgttaagtagttaatatgagcaaggaacagtgagaaataaagatcagtaagaaaggttctgtcttcaatggttcgcagcaacgtggttgaaaaaccttggcaagagtacatgaactaaataatattaaccacacacaggttgtgatctgattgtaggtattaggcagagtatcagaacagaatgcatttctgtaatcctcatgttaaagaaaatggattcttttctttttataagactaatgatgactaatataagactaataagaataaaccaacttttattgttctgtttcctataccttattgtaaaattaatatttattgagcacttagtaggggtcaggcattcactgttctgtgtttaccatatgtatgaattcctttagtccttaacatctcatgaggtgggcatgttatgatcgtccctttagaatatataaaggaactgaggcacagcgtggctcattagctgctcaaggtcacagagctcataacttatgaaaccaggctggtaaaacaagctgcaggacttgtgagtcaacactcttaacctctgtgctttatactttctctcatttcactgcatattagttaacacctctctgctgtaagcctaaatagatgtccaatttgcactaggaaaatacaggctttaggctaggatcagagacttgaaatttatttctgtagaaaaggatgagttattttgatgtaagtattcacagcactacataatttaagtgattaaattcatccccctttggtgaggttggggggagtttctaggagaatgacaccctcacctttggatgttgagagatgcatatttatggaagtgtgcatttcctctacctgctcagtctaaactgactttcttcctggacagatccttgtgatgatgacttctgtcacagatcacaagagagccagtcacaaactgggtgtctgcactgaagagagtcctttagagactgagtgtctgatggacctgtgtttgcaattgtctttttctatttatgtgacttcggaaagttactactgagttttatttcttcttctccttaaaatggtaatgataaaagtgaaaatacctagctcatagggtggttgtgagaatgaaatctgaaaacatctataagcaccctagctgcataagagctataccagtttttctcaaaatgttaagtacctgtgaagtcatctggagatctttttaaaatgcagacactgattcattttatttagttgatctagggtgaggcctgagattttgcatttctaacaagctctgaaatgatactgtgctggttcaagggccacactttgagtcacaaggtcctgcacaatatgcatagaagaaatgttcctattaataggagctgttaaagtttgtattaacagaatatttctgttgataactttgcactcagtttggggttgtctgctgaaatatgtacatataatgtataagtattgagaaatatggcatttagaatcttttcattgggaaataatgcattctataatggttttgtgctgcattgtgacaaaaaataaatttggagtcctctttggaataagattccattaaaaattcacccatgttgccaggtacggtggctcatacccataatctccgtacttgggaggccaaggcacatggattgcttgagcccaggagtctgagaccagcctgggcaacatggcgaaaccagatctctccaaaaaaaaaaaaaaaaaaattggctgggtgtcatggcgcacacccagctactcaggtggtgtattctcagctactcaggaagctgaagcaggaggatcgcttgagcccaggagttggaggttgtggcgagccaagattgtgccattgtattccagcctgggtgacagagcaagcctctgtctcaaaaataaaaaataagaaaataaatccagcactttgggaggccgaggcaggcagatcacgaggtcaggagatcgagaccatcctggctaacacagtgaaactctgtgtctactaaaaatacaaaaaaattagttgggaatggtggcgggcgcctgtagtcccagctaataggcaggctgaggcaggagaatggcgtgaacccgggaggcagagcttgcagtgagccgagatggcgccactgcattctagcctgggcgacagagtcagactctgtctcaaaataaataaataaataaataaataaataaataaataaataaataaataaataaatggcgccactgcactccagcctgggtgacagagtgagactctgtctcaaaataaataaataaattaattaaattaaaataaaaattcagccatattaaaagactcatgagtgtagtaatgaatgaaagatgtgattgagtaactttgtatcatatgtttatttctagcagccagattttcttgactaaagctataattagtcatggctctctgattattctaaaaagtgaatttattatcttgagggcgttgctcttaatatattttgaataataaaatgctgaaattaagtatgcttgacttgtgtctgataaatttgaatcttaaaacggacttttgaaaatataggaagaaaaactgtataggaatatcccgtcacttgtaatgttgacaaaaatagtagaacctatgactcacgtatgtatttcccaaacgtgagttgagtaactggctccagttgttactgatggcatgccgtgcttgtgccatatctgtgttctctgataactgctaaatcaactgctgcctaaagtagtgtcaaggcagtgaaaagcctctggccacctgtggaattgtttcgggggatgggactttctactttggggaaaatctgtaaatctatggtgtaaggcaatcctttgtgttttgtttctgttagactacttttgtgttaccaaagtagtctaacagaaatacttagtagtctaacagaaatccgtgttgccaaaagttcttcataaattttattgctctgtcttgcataaatggcctgtatacaggctctttaaaatggttggtaagagtggaaatgggaagagagtcttgccctacttaaactccagaaaatatgataatggttgcctgtaggagctctgactaatcatatattttttgatgacatgtgcttgccatcaaaacagcatcaaagagagaggaaaagaattatatcagagcctggttcatcccagtgtcctggcctcctagggaggtgttagaatgggatggttttttacttgcagctgcaagatacgccagcatctcttggatcagagcccttcgtgaagtaagggagaattacaataggactgtagctcaggccaagggattaatagaaagattaaattttgtatgttttaattcaatacaaaaatgctacataaacatctgcctttttaaaaaatatgaaatcctttccatcttggtgatcagcttgatcagcaaccacacctcacacttactgttttcaataacaaatggaatgcagatggcatttgtttcaacgataactacagacagcaataactaatgaataacttcagtgatacctggagtcacctgtggagatggtgaaaatatttagaactgacaattcctactgcattcatggaaaaagaagtaaagtggagtggggcctcagcatctggatttttaaactgttctattgttgatttgaatcaattcatcatgaattagcaagttgctagtaagtagcattaactactgatgatgatcaattcttttcttgagagacgaaggcagtaaactattacagagaaggtctgtgctttggcttcaaagagacctgggttcatactttgggtctgtcacagaattatgtgaaatacctcttttcctctgtttctttatgtgataaggggggataatactccctatatcatagggtggtggaggttaaatgtaaaaacataacgactagtatagtgcttagtacattacagacttttgctcctcaaagtctcgccctgggatcagcagtatttgtatcacagcagatagatccaagaaatgcagtatctcaggcccattccagacctcctcagtcagaatctgcatttccgggggattcctctgtaacctgtagtgtgacaagcactgatacaaacaaacgttaaatgtttgttagcgtagtagcatttaccgtaattgttgattgcttttacagttctgagctgataatcttaaaaacgccatgatggttgaaacaaaaacacttcgtggtatttattttctggtattttctttttattcatactaactagagtagtttctgttgctggtgaagatttgtttggggttcagtaaaactttcaaaatcgcctttcagatcttaagtatcttttagttatctccttctttttgtgtttatgcatttaaacataaactataaagccaaaatgcagtttaaaattaggcacaatgtatctacaaataaaagctcatctagcaaccaataaaatggaaacttgcagattcccagccagattttaaaaatcagatcaaatatttggaaactatgttatttgttgacgcctataaatttaaaaataagtcaaacaaatctgctattcttgcaaagcctaaattttatgagttccccatcattattggaatgagaaattgccattgtaaactctgtgctaaatttactttcttttttgacttttaaaactcaccaatatattgcttgtaatttagctctgacaaaaacataaaaaaggctaaatttaagaggcacttctgttgtgttcctcaaaaaaatttttagccatccaacttatgtatttgtcatctacagctaggcttaaatattattgaaattattgaaggcttttgaaagtttctttgcagttgtttaaaataacagctttgccattaatggcaggcaatcacaacattcatccagtattttgattttttttttcttggagcacaaactgagtgagaaaagtaattttctttttcacatatagaatctattttagttactctagcaggtttttgttgttgttgatgaccaattttcaggtccaaatgttaaccttaacaattcacaaggggtggtgggaactaaagattttttttcactctctagtccaacttacttcagcacctgctagtcactataggcagcctgacttttaacaggctcatcagcaaatccgtggatgaaatgtcttgaggacattcaaccacactgaggggcccagtgatcatcaaggatgcttgcagtagcagcctattaacttccttttatctgcttatgagattaatttgggttgatcagatacttgattgtactgtatttttctcccttcctgtactctgtggttgatttctcattaaatccagtggtgacacctccacaaggcttcgaaatctgtctttaacttccagctaatggaggagcttgctgtgaatagtacaagctcttatttttcaggacagtaataatgactgagggaataaaatcctttgtaccggctctcctgtccaaccttgaaagatgtgttgctgcaggatcggtggctcttcagagtatcccttattgtcaatcacgttaactaatcaccagcagaggactcttgaatttggcaaacttgggatttactctttaaaagtgctgttagctcatggaacttgaaggacctgtcattctttctgctgactcattttttattccttcattgtgctctggtatatgaggaggaagggatctctattttggtagatataattatgtcctttagtgaatttctgagtgagcagataagtctgacatttcctcccactttgtttctctccttggacaccccccaccccagttgtcacaatagtgttgtggaaagagcactgggccgggggtagaccctatttgcttggcccctgctctgcctgtggccagctgtgtgacctcaagcagtcccataaactttttaggagaactttccaattgtccactttccagcacatttatctaagtcatggtttagaggaagagagaagagagagataattaaggaaataactagtattgagaataaaaatatttgtcttaggttgaacatatgcaatcgccatttttgtaggctacgtattttcatagaacttgaccaaataggttcctctatccacacctcaaggcctaaggactctaacatatgtaaggcaagttctatagatgtgtcagaaatttccctactcaagtcagatctggcttgagtccacctagtggaggagatggaaattgttcttagtatttacaactactttttctatctcttcccttacatattattctctctcctccctggttaactccagaccttcagaaccttcatactctttccatcctatccattcatcattagttcatctaccttattcatctccctacttgtttcacatgtgtttttaatacttaccatattccatgtaccacacaagagaaaggaaaaaggtgagctagagaatggtcataaactcaataacaggccattctaaataggtgatatgcctttatgttgctgaagatactccattttaaccacagaatcattttatatgctttttaaaaaaatgtttgtgttattgtggaattacaggaataagaaaattacatgggaaagtggtttagttcagaaattgtacatattggtgaggtttggaaagactgttcctttatatactgtgcctttttgaagaaggttcaaattcctgtctgattttaggtagcacatgaataattgccttattagcttttcttctctttcctgaactaagccaagttccaatcaaattgtatagtgtgccccagatgagacgcgccctggtgcacaatagaaccatataaatgttgttatccacttcttttaaattggagagctgtaacttttttgtagctttgaatatttcatttagaatttatataaaaagtagggcagaaatcgaaatatttctgctttccattatgtattcgcctcatttttagagagatatttaacatttcaaactagttaaatttattttactcttctttgaggtgagaatgcctttgagatttctagtggaataaatgtaaagctcccatgtcactcggccttctcaggtcctttctctcttatttgaaccatctcctgacaataacatttagaacaatatcatctacatgtaaagcctgtattaaagtaatcccttcttcactatcgatttagcagcattaaacactgttcatctgtaaagctggggcacaatcagaaaattattttttctagtcccatactttaggatatgaatgtgagcatcacaatttgaattacttggcctgtttctttttcataatcacaaactttgggcataagagaaagatttttggatgttgagaaagggatattgagtgtaactgtcatggttctaagctatcacagagtaactaatttttgtggattaccatatcagatatcacagaatccattttacctccaagagtatagttagatacatctttgatttgtcagtgagaataactttcaaggcttacttaatgggaacgtatcattttgatataccgcgtcccttatcttctacttagcaagagattattatttccatattgaaaggatctaattctatagacagacgcagaatgttttttgtttgtttccacctctacagtatgctggtgaggatcatgctgattgccgattggcaggggcatccaaggtggttttcttgttaggtgcacaggagaagaaagcagacagtcatggataatagtaagccgacattcgagaacaggattgaaggcaaagtgtggggtcactgtaggagagagaaaaataacagttagtttcaagatgaagaaagaagcaagaataatgtccccttgggagaaaaatacctccaataagcatatgggaaatgagaaaggattcatgaggggaaaggaggattctgggaagggctgggaagttggcttggggaagaaaaggtgcctggtttagagaagggtgtcaggatggagaaagtatgacagggaaaagaactccattactaaagggtggatgccattttaaataatgtcaacctcaaggatggttggcccacttctggaatgaatagcatcaaaggtttatgtgttatttatcctttcttaaggcctcctcatgttagaaagtagcaaacctactcttctagatgctcaggcccataaccttggagttatctttgaacccgttcagtctcccagactccatatccactgatttccagttctttcttattggctctactagggaaaatatatctagacccacgactatttctcaccacctccattgctacctccctggtccaaagctctattctctctgtcagattattacagtagcctctgacttgttggcccagttcttggcttgggcctttgtttccatatagactattctcaacactttagtggagagtcacacctctcaaagggatacacacctcacccacagtgaaagctccagtcctcactatctctcatgaagcccaaagtcagggcttctcacctgggggcacattagaatcctcaggggatttttatagacatgctgatgtctaggctttaacaaatttgaatccctggaagtggagcctagaggcattgtatcttttaaaagctcccatgtcctaagttttggggatcaacaatgaataagacctagttccaagtcttaagcttttgacacctgaccagggacacccaccctggtaactgtaatagtctttggtgagtaccaagaagaacaaattgctggggaatctcaggaaaagtcaggtgtcttagtctgtttgggctgctgtaacaaaaacaccatagaccacttgactttaacaacatacagttattctcacagttgtggagcttgggaagtcaaagatcaaggtgctgacagattcagagcctaggaaggacctgcttcctggcttatggttgttttgttttttttttttttcactttgtcctcatatgactgaaggggtgagggagttctatgggatcttttttataagagcactaacctcattcataagtctcagctctcattacccaatcagcttccaaaagccccacgtccaaatacaatcacactggggatgaagcttcaacatatgaatgctgggggcacatagacattcaatctatatctccaaaactacacaaagtggaggggagtcaaagaagtggcatttttctggactttgaaggatgaggaaggctttccctgagagaggagagaaagtgcagtcaagatgacctcatttattatggctacaaaatgctagtaggaaccatgctgatgtgattatagaagaagctttcaaattaggcaaaccccggttcaatttcttggcaaattacttcacctcttagtgtctcaattttcctgtctctgaaatggagataatcatagtaccagtctcatagggatgtaagaattatcaactgtctttggcatattgtaggtacttcataatgttaactttctacaatagctaattaggcatttctctcaaagaaaagtaaaggaaatagcttttaaatggcttacggtttttcttgggtgctgtatacccttgctactcacaatgtggtcctcacaccagcacgggcagcagttggcagaaattgcaatgcctcactcagggcccattgcggaactactgaacagaatctgcattctaataagatttatcccccagatgatttgtgtgcacattaaatttgagaagcattattgtagagcataaaaaggtgagcaagaaatagctcttgcctttgtggtgcttagaggtccctttaataactttagcatttacagaaataattataatgcagggtataatgtgataaatgacatgagacgtcctcaccaaatactaaaatacagcagattgttttaagctccagttgaaaatagtataaagttccttttctctctaataaggtatgaaagttcttaaagttataataagcccccttccctttctgccatccttcaattgctgtaaaccatagagcttattgaatatctaagcagagagctacatctgtttatgcacattgggaacaattgaccaacaagtacgagttgaatccgttgcctgaaataaaaggcacaagaagtactagaagttaataaaaaaagacccaatagttttgtctatgagatgaagtagactatctagagaaagatcaaggttaagataagcatgtgaatataaatattagtttccttaatttttgatgctcagcgcttttcaaaagaaaaccctattttttaaatataacagcaatgaataaaacaaaaagaagtcttcaatttccccagttgacattatgatcaaaatatcaatttaataattatcctccttttaataggactgatttcatcttgtcaagtttaccattacaagttactagaacagccagagtaaagcaatttgagttccatatagtcaccacaatgtaattattatttttgaaattaattttgccgttttctttttgtttaagaaatgaggtcttactgtgttgcccaggctggtatcaaactccagtgatcaagtggtcctcctacctcagcctcccaaacaggtgggattacagacacacaaaattttcaagtttggggatatttaacttcagttcgtggtaaaaatcacatggtctagtgtaatctaagcaaaaaaaaataataaaataagtgtttctgtcactggctgtaaataatggtacagtcatgtgatagaccatatatatgattataatatcatgtttttaaagtaccttttctatgtttaaatacataaatacttatacctgtgtaacagttgcctccagtattcagaacagtaacatgctctacaggtctgtagcctaggaacaataggctataccagatagccaagttataccatctaggtttgtgtaagtgcactctgtgatgtccacatgaagatattgcctgacaatccatttcttagaatgtatctctgttgttaagccacacatcactgtatttaaccaaagtgaacacattctgctgggttttgttcttgatacacgtgtgtaaaattatcacttttcaggtgatacattagaccaatgatattctgacacagcagaaatgaaattattcatagcaaattacatttaatattttctgtttttaataaatgtaaagatctgttattgtcttatttcaagtttcatttttgctggcaaaaggttttggcctttactttcaagaacttaacttaaagtgaaattccctacattcttcaaataaggtatgcttgaataaaagcatctaaaagaaagtgtttttttataaatgacaacatacttaggaatttttacaatttgtttggggcaaaaattgtttgaaagaagtagatgttggataacacatattcagaaatatttatattattttcttggttattttatgctattggagtagatgcttcacttctctataggaattaccaattctcaattcctcttcaccacttatatatttttgattttgtcccaaatagccaaacatgctgccataacttctgagctcagaatgaaggatctgattaggaaaagcaacatgttaacagtgtacatgctccatctataactgtgatgaatgtatactttggatttatcatcacttttaaattattgagatttttaaaaactctattagtgctagctaagacttgtttactgcatgggctatgttgttttggtgcacatctatctttgtaagctatttctttctagaagctatttctttctaccttttgtacagggtagaaactttgcagaaatccgaggtcttcagagttagaattcaggggagaactgatgatgggtagtctattgatgggttaagtcctgaaggttattcaggtaaacatgaacctttcccctgaataccttattttctgtcatttcatcattatgattttggatgcctcattacatctgtaaaagcaattaagagttgaaggaattctttttttatagttcctgtctgctgatgacccattaatgtccatatagatatattataaaatatttataaatgaatacttacattgatttttatttgagctggttttacatttgacttattatttattggactatttaatttagtaaggaaacacctctttttcatttttaattagtgcatggaaggcttataagattaaaaatagttgtgtttagggaaataagcttatttcttatgatgagcagttacctactatagattatatttaatctggtaactaaaatattattattttttagtttacatatcagaacctagatataatggccagaagatgtaatgctataatatagttaatttgcagtaataatcacattttcagtaaatatttgttagaactatatgaaattgctgataattgatcatttctgacctacagatatgacagctgcatagattcaacctactatgaaaagccaaaacatggaatattacactaattaaacggttacacaacagaacatggaatgtgcgacacttcatcttgggatgcaaatttttgtgctaaaaaaaactgagaaaaacaaaaagaaaaacatgtatttctgaggaacttgtttttatatctggcataaatgagaaaaagctaattaaaactattaattatcagaaaattgaagataaagttgaagagcctataccaaccaaagttgaataaatggcaaaatataatatagatgagttactctgaaataattttttatttcctactatctaacttaccaaacttcctgattttaattacataacaattttttggttattttaatattcatttggtacttatttccttttttattgttatagtattagatgaaatcataacatcaatttgctcctttgtaaaagaggatgttgagttagaagtgttctaaggtggctttcagcaataggctgccataccaattggaaaaatctagcatggtataaaagaatatttaagcagtaattatgactggaaaacatcagagtggaaatgaagtatggctgagaaacctttttgcttttagctttttttggagttcattacaataaaatgaaattatagaaacttaacccatgagtatttttctctttgaactttagttcctattgaaattggagaggaaactacacagtaatctaagggtgatcacaggagatgtcagctgccttccagggctttttgcaacgtggaattgcctttactcgtttattgaagagtgcccgttatgtgttggggctggactcacagtttctagggtgtagatcttagccatggagatccagacacttacggggttaggatattgggagtagtgctcttatgcagggacaggcttgcattaaccaaactcaccagatattagtgtataaccaaaatgcaaatttattggtttacaataagaattctttgcactaagtaatttagaatacacacgtaaacccactctgtgctaactaactgaaagtcactttatagggaaaatcaaattataattagaagatcatgtaatttttatcctcattttgtgaatatggtgttcacatttactgattgcagatattgaaccatcctttcatgtttgggataaatcccacttgatcatggtgaggtgtccttttaatgtgcttttgaattcagtttgctagtattttgttgaggactttttgcatctatgttcatcaggaatattggcctgtagtttatttatttattattcttgtagtgtccttgtccggctctggtatcatggtaatgatggccttgtaaaattagtttggaagtatttcctcctcttcaattttttaatatagtttgagaaggattggtattaggtcttctttaaatgtttggtagaatttgtcagtgaagtcattaggtcctggacttttctttgataggaaatattttattactgaatcagtctccttactcattattgatctgttcagattttctttttcttcctggttcagtcttggtaggttccatgtttgtagttcatttgtttcttctaggttatcctacttgttggtatataatagtttataatagtctcttctgatcctttgtatttttgtggtatcagttgtaacatctcctttttcatttctgattttgtttgggtcttctttttttctttgttagtgtagctaaagttttgttcatttttatcaaagggtacaaaattttagagtggaggaatcagttttaatgtatgtattttatatttcaaaattattggagaatagatttttaacgttctcaccacaaaatatggtaagttggtgagttgataggtatgttaattaacttgatgcatctttctacaatgtataacataaatcaaaataacatattgtactccataaatatacaattattatttgtcagttaaaataaatatgtaaaaattatacttagaaggccactttggtaagtgtcggcttaagagtgaatggaataattgtcgattagtaaacaaaagaaatgtcatctctccaaaaaaaaaaaaaacagtgaatggaatgaactgtataattcaatgtttgatgatactggtctctgatattctgtgctctctgattcacaaaagtgatgtgcctgtcaggggatcagattgctcaagaacatgggccagagtataattcctgttgatggcacttggatccagattatgtcttttgaagccttctgtttctttcctccatttcacattacactctccttgctgccttttatgcattttatgtaggcttactaacccagctctctagcttagtgcctggcccccagaagtactgaagaaatgtttaactaccgtttagctagccacaacattcttactagttttgctttgggaatagtgtatattttacttctaaggtactttgggtctattttattgctgcattctaaggcttgtgtgtatgtgtgtgtgtgtgtgtgtgtgttccgtgtgtgagaataatgggaaggtatgatacccacctctcataccttgatgctttgggaaaataaaaattttctgattatattattttgcagatgttctagttatacttatcaatcttttctgcttgccaaatgaagatttagattgtgaagattcttttcagagacataggttcaaaactaaatgaaacccagggcatctgtaattcttcacactttagtgaagctctgtgataatagtgagtagatgtgtggtgtggggacacttggggtggtatttcagacacttagatatttgccggaaatctgaaacttgttagttcacatttagttttcactaaatggattatatttttctcctaaaactgctattccactattaaaattaatggacatacaagataccttgtctgtaaatagaacagatatttttaatattttgtcacagtcccccaaagcattagtctgtaatgttgactaatgggttgaaaagatattaacttcagaaaaaccaaagagaattaatctcttagaatacttctgaaaccaccaacttctgtttttgattttatatttctatacctcaggagggaaaaaaaaaacaaccaaaaactatttcccctctactccctccctgttttctaaaaataagtcacttttggtttgttaccttataacacatgccaaaatttatcccagagtgaatttttgtagccaacttagaaccccaaaatagaaactgctgacagttccttaaatacagtaacactggcaggtgccttggtaataaattcacaagcttagaatctacaaaacaataaagttatgcaaattggagcatgtaggaagaataatctgaaacaaatggcagaacagtaagtttagcattgtggcatcctggttttactaacacaaggcaaataaccctgaggagaatcagggaaattttagatcaaggaggattacacagacatacagtaatacatgaatacaatttgagttgaccaattaataactggtttctctgttatcacaaccataaacagagatgggaaactgatcataggttttgcatttgataggtacaactatcaagaggtaaatggaaaataacaagacacctaacttgaagtgatcacatgtgcagagcctcttagcttttgttttaattgttccttcagcatcattcccatcagtcatattcagattagttgtttaattttagccaatcaggcatgtaatacatttgtgaatttcatttattttaaatgtctttgcctttgcctaattatcttttacttttgttattaatctctgatatggcataatgaaaaatcgtgttttttaatgaaaagaaaagatgtgttcagttaacatattttcaggaaatacatattttcagttaaaattagaatagctctaataatatcagacaaaaatgtagctgaggaatatagcactaccttttattagttgtgtagtaaaatgtaactttttgaccctgtagtatcgcttgcagaatgtaacagaaatgtttaacttttcttgtttttgttttcatcaacctcaagttactcccaaagaagttcaaaatgtatcccagaacttaaagtataataaaaaaattttaaaaaaagaagtacaaaatgtctattgtgtacacaggaaaaatatattagaataatgattatcttaagtatactacctaccttattcgaggtgatgaagtagtggactgctacaagtttgttggagagagggactagaactgtccttttaaatgctatattctatatcatagcatttttgtctggcacttggtagatcctcaatagagattgcttgaaataataaacaatatcacctccaaactcaggttcacaaaatttgagttcagtggcacagtggtgatcacatgtgcggagcctcttaggaaaaggaggcctagagaagtattgagttagatgctcaggttccagagccaggactggaacacagatactggacttctgtcaagcacaatatacttttcatggcctttgcccgtcattcagatgtttaaatttgcttaaaacagtgccatctattttctttggagttcgaataaaagttctttctaacagagtgagtaattcacacacagatacttaataatttccctgattattttttcatttagagattttcaaactaacaaccaaaatattctggtagaaataaggtaaggttgagaagtaaatattataaactggtctgtttagccagagttcccctaagagccttcctcattccacctcaaagaccattttttagtttttccaagtgtctgtgaattgtggctgtgcatgcgcacatgtgtgtgtgtgtgtgtgtgtgtgtgtgtgtgagagagagagagagagagatttttactttaaaaaattctcatcacttaagcttgactgttgcttttcttcttgcatgtagcttttctaaccaaataaattaaaaatacttaaaattgagtatattccgtaattggtccaataaaagaggggatgcattggaagggagctatggcacagggattaaaaaaaatgttttgcacctggctcctctatattaggtgtggaatggcagtcaagccgttgagctgctgtggatttcaattaatgcatttctaaaatactttccagaaattcaagatggtgattatttaaatagttgaaaaatactacatctcaatttggcctatctttttgtgttgaagatagaggatgtaatcttttttcatgttcagtagactgtgagctaatagttttgttaggggctgagaaatcaacatacaccttacggcactggagaagcagaaacctggcttaatttcagaagtgcaggaatctttgacagaaatattctactgtgaggaaataaatttacacaaggatcccttctcagagtatttactaaagtctgaaaagccttaatttattttatgccaaaatttatgtttatgtcatgccaaatatagttgctgatattgttaggtattaatttgtgtgccaaaagatactctttatactgtattctctgatcacaatgtaataaagcagaaattagtaagaaaaaacagtaatacaaaataaacaacgatttggaaggaacaagccattaaaaactactgagtcagaggcagtttttaaacagagctcaactagagatagaaatagagaatgttaaaacagtctttaccattggatggggtgaagttggagagaggaaatggggagatttaggccaaagaatacaaaatagcacatgtgttggattactaattaagagatctcatgtacaacatgaggattaaagttaataaaattgtacagtattagggatttttgttaagtagattttagctgctcttgtcacacacaaatagtaactatgtgagatgatagctatgttcatctgcttcactatatagccattttactatctctctatatcccatgtcatcaggatataaacctcaaatacacaccatgaaatgtgtttttaaaacacttgcaatcataggttatttagaaaatagtaacaccattaagggaataaacaaaatggtgcaccttatgaggtgcagccaaagctgttctcatggcaaatatattagtattaaataatttcactatgaaacaacaaacaacaacaaaaaaccccagcaaatcatttaggtattttttaaggtaaaatttaaacataatctagcaatgttaaggagaatgaggtatgataaaatataaagttaaagaatcagtaaaaagtggagtttatatatgcaagagctggttcttaaaaataataatgacaaatgtctgaaaatatagctaaaaatgttaagtacagttattttaaaaatgagtaaagaagtttaaatgaaatataaattataataaaaatagaaattataagctaacacactgtgaaacttggtggcaggaaaaaagtcaatgactacttataatttcagagtagaaaaatacagattttgaaaagggaaaaactggagaaatatcatttgaggattacttctcaaaatgtttttaccagttagattttcaaattttcaagagataaattcttatttaatgaatagaagttgctagaaagtattccaatgactgtttttgaaggtctcatactcctgaatctaaaacctgacagaatatcatatcacaaaaaatctacagaccaataatttttatgactttataggcaaaagtgtaagtataaagtagcaaattaaatttagcaatattttaaaataataattcacctgaatcaggaatggcttagagtcaggaattcattaataatcacagaactagatcaaaagaaaaaacatctcaccagagatggataaaaagctattcctgcaggaaaatattaataaactagaaataatataatccttattatgtaagaaaatgtatctcaatctatttcataatttgtcaaatgccagaggcattcttgttacaatcagggcatgttttatattaaagattattggtgatggtcactttttcaaaaatcacgtaacttttccagtgcattaataaaaaacatacgtttatatccattatttccagaaactccactcaaatagtaataagaatttaaattatgaatgcacaggaaaaagaataggaacaaagataattgtaaagaaggaatgttagcaaattttaggaatatatgaagagggtggaggagttagcaccacagaggaagttcaggttcgatgtctataaggagagtgacattgagaagcaagctattttgctctctgaaactctaatgggtccagagattacaggcggggatgaggttaagggctgagtacataatggtaggttaaaaatgtgtgtaaataacaaatcaccagatcacttctctcccctctttggctcactaccctgcacacttaggagacaacttttctttttgtccggcagggttttagaagttgattattagaagaaattaatccatagattttgagactttcagacacctgaaatatgggaagctgggagtgagggattgaaaagggattaagagaaagtcttcatattgaaagtgagaattgtcaacttacttcccacctgcccaccatctttcagaagattttccaaccctaaggagataaataaaaccttgaaaataggaagaagtgaaaaaatggaaattggaagaaatacatgtaatgcagggcacaggagaaaaattaaaacaatttagcaatagctgcagagagataaaaatactgatctttatgccaccaacaatcttaggtcctaatcttgtggcttcttcagcaggtaggacggtgacccagagatcccatctcatggttcctttttgattgctcattgccatgttccaaggtttcatcaggcccacaatggtcttgatgtacatggattttcttcttatcttagtgcaagtctgggaaggctattagctgtttttcattgctttaacttgcaagagtctattggagcctgggagagtaaaagggcaagaattagataactttaattttagacatctctaacgagtctgaaaagattaatggggaaagtagatttattctcaggtaaagggtgggggtaaatgctgagctactgtttatccttctaagaatgtttagaatctctttctcatagaaggaagtaaagaaaaaggcaggattattagccctgctatacctggggtggtaccaaaccatcaccttcactggctgtcagcagaactgatgagtgaagaaaggatcatggctgatgcaatggtggggaagtgattttgtatggaaggccaatccataaataatggcaagtgtaagacatgaactagtatatttcaagaagtacttcagtcacacagacattttgtagtttgtctttttatttattttattgctcatgatgtaacattgatgatgtaaatgatataattataaaatatttagtttagagcaatgcttttacattttctcttaagaaaattaagaatttaccttctctagtcagaatggctgagatcaaatttttactcaaatgcttgctagatatcaggtcttggacaagtattttaacctcttgtgcctcagtttttccatttacaagatagaaattaatagcacatagcatatcttgtatcaggtcaaacagatgttattgttaatgttgttgttattattataagcattttggcctagcctcattttaaatccttcatgagatgttgcccagatctggttatccatgtgctatatcctaacctctctctttgtgtcccatgttttcacattcaaccactgacccaaatgcagtccacatacataagcagagttaagcaaacaaggctctgtggaatgaattctgtaatgagaagactgttgatttatactgtcctctctgctgtaaataacatcttcattttaacatatgtacttttcactatgaatatatgtaaaattgtctctatattttaaagaataaaactgatagaaatttggctgcaatcctagccatttgggtgagatttaattattattgctagtttaatctcatgctacatatttcaaaaagtcactctccaagttcaggatatttattataatacttcattatgctaatttcatgttttataagatgacaagctattgtcatgatttattccttgtctatattcttttgaggaagccaattgaacgttaagttcttatggatgtatttctttaaaaagtggtagtgtcataccatgtactgtcattatttaaaactgtgacattctgacagtgtgtcagaaaaaaatggtggctgtgtgaaatttacatgcctaagtttgtaactaaaactaattttgtcaggatatattttataattaccaatttaaagaagcgtataattaaagtaaaatgagctctgcttgtgcctagaaacataatttttaatgcttttgttagattttcttcaattgaattataatatatttaatttatatcagaaacagtgatagagtaagattatttttcaaaaaattgcagtcatttggagaaattcatgaacaacttactatattaattattttcacattaatttagtgacttttaaaagaggaacagcaaatcaaccaactttcaaatgctcccccttcttatacttctgtattttatttatagcagaggaaaacctttcttcctttcttcctgtcagctgtgcagtagcagttctactgaaattggataaagaatctccaaaatatgctttagcactttgagttagcctctgttcaataatttgagtaagatgattatttttctagctaaatcaactacatggtttcatgatataggtctaaaaagcagcttatttttttaacattcctgtataacactttgaaaacatccctcagtaaggggaatttatttttacagagtaactttgtagacatgtaatgaatgttttttacatttggattctaatgttataataatgtgcatttttagttcctgatctcatcttccttgcaagggcacttgctgactccggccagcctgatcatctggtaacagcgtaagacttgcagcgtgtgtatgtgctgaacttcattaccattgagtagaaatatttagtcgccatattaaaaaggtttcattattgaatgtatttgaagtggcccgcttaggaaatgattgggcatgtgccactacattcaaaaaagatggtgcatatttttaaaaccagctatctttctgaaaattgaaggagatgggtaaataacatctatttttgtataaaaattaaataactgtgaatgatggataaatcgcttaacttctttggacttcagttttctcatctgtaaaataaatgtaacattatccttctctggtgagttcaaatagttttaaaaatgagataatgagataatcaatgtgaaaatgctttgaaaagtatagagcactgtgcaactttaaggcattactatttttcactattgttttgatatttaaatctacaacagggttaagtacctttttcctggtaaacaggaatggaaaaataaaattattgtctttaagataattcacatttcagaagtagaaatagaatgtgcacaggctatgaagatacagggtaagttatatataatcaattgaatatgcagtaacaactcaccatgttggcaatgttgcagtgggtggtaaagtaccattgctattcaaagaaatatctgaacagaggaagagaaatgacaacgatgttgcagtgataatgacaacaatacggatataatctctattgaggcacaggtttttgtctctttttccttaatgttttcttagatccaaggattaggctcaaggtacgtagcaggtacttaataaatatttggcagtattactgagtgaatatcacttactttgacataaacaaaaagtttacacctattttcatgtcatcaagaatgcatttagtatttcctacttctactgaaaagtcatgtagtttttgttatttattctattaatatggcatcttttatttattgattttcagatgataaatcaatcttgcattattgggataaatcctacttggtcaaggtatataatgctttttatatagtgttgtattctatttaaataacattggtctataattttcttttcttgtaatgtgtccctcagattttggtatcagggtaattctgatcccatataataaattgagaaagagtccttagtctttaatttttatggaagtttacagagaattggcattattattatttttttaaatcctcggtagaattcaacagtcaactccatctgggcctagagcttttcctgtggaaggattttaaattatgaaaccaaatcctttaataaatatcgtgctattcatgctacctatttcttcttgaatttggtagtttgtgttttccaaggaatttgtccatttcatgtaagttttcaaatgtataggcataaagttgttggtaatattctcttattatgctttgagtatatgtagaatctgtagtgacgtcattatttccattcctaatattggtaattagtatcttgcctttttttttctccatgatcagtcaggctacaagtttgtcagtattctggatcttctaaaataatcagcttttgatttcattgattttctctattgtttttctactttctattttactgatttccactctgatcttcattattgcctttcttcaacttcctttgggtttcatgtgcttctctttttctagtttcgtaaagtggaagctgaagcaattggcttaagatctttcttcttttctactataggcacttaatgctataaattttcccctaagttctattttagcagcaatctgcagattttgatatgttttcattttcattgtttaaaatatttttaaaaaattaaaaaagaatgtactatgtgaagtaatagatacgataatttgcatagtagcttcattgtgtatatgtagttcaaaactttatattgtacaccttacagttatacactaaaacataaaaataacatatttcctattttttaattcttttatctgtagattatttagaaatgctgtatttattttccacatattttaagattttaacatatatgtttctgtaagtgatttctaatttattctactggggattaaaaacataacttctatgacattaattcttttaaatttcttgagatgtgttattgcacacaatgtggtctataagaccacatttataggtaaatattcaatatgcatttgaaaagaatgtgtattatgctgttgagttttctacaagtgctaatgaggtcaagtatgttgatagtggtatttaagtcttgcatattcttactgattttctgtctatgttttctatcagttattgagaaaatagtattgagatttcctactataattgtggatttgtctgtttttccttgccattctgttaatttttgcttcatgtgtttggaaccttttttattaggtgcataaacatttaggattgctatatcctcttgataaattggcccctttaccattatgaaatgatatttatctccaataatattctttgctttgcaaactatatgtcttaaactttcttttgattagtgttagcatagtatatcttttccactccattcacttttaacctatttgagtcatatttataatgagtaccttgaaggctgcatataattggatttttaatccaatctggtaatctccacctttaaattggaatgtttagaccatatacctttagtgtgattattgatatggttaggtttaaatctactattttgctactcatttcctacttgttctgtccgttctttgttccctttttacttttgtacctttttatgggttgattattttgaaaatgattccattgtatctccttttattggcttattgtctacaactcttagttttgttattttagttgttacttcaggatttatagtatacatctttaaattgtaatctatcttcaagtgatattatagcatttcatgtatatcacgggaattttaccaaaagtgtgtttccatttctccctcctattgtgctgtcattgtcatagattttactttatattagttataaatcccatgctgaatttttatgagttttgtttaaacattcaagtatctttagatatttaaataattaaaaatgtttattttttcatatggttaccttctcctgtgccttttattctttgtataaatcaattttcccatttggcatcagtttccttctgcttgaaggacttccttaaacatttgttgaagtccaagtctgctggtgatgaattctttcagtttttgtatgtttgaagaagtcttttccattttctgtaagatattttggctgggtatagaatcccaagttgacttttttttttcttttagtattttgaaaatgttggctccactatcttcttggttacaatgtttctgacataaaatatctgccatccttatcttttttcttttgtacttaaagtgtgtgttttcccccctgactacttttaagattttcccctacctccatgactcttttggagaaatttgatgataatgtgccttggagtagttttattcatgttttgtgtgtgtgtgtgtgtgtttgtgtgtgcacacacacatgtgcctggtggttgttgagctttttgattctgtggatttatattttccatcaaaatttgaaaatttttttgccagtatttcttcaaattatcttctactctttgggggcttcaaatatatgtaacttaaaatgctcccacatgttgacaattctctcttcttttttaaaaaatttaattctcttttttctgagtgtttcatattttggtagtttctgttgctgtatcttcaggtatgctaatctttttttcctgcgatatctaattggctgttagtctcatccaaagtgttttttatctgacaggttatagtttcatctctagaacttctattttgttctttctaatgtcttttatgccactacttagttttttggacataggggatacagtgacacaactgtttcaatgtgtttttttctattttctcttcaattaattctagggtttctatcagtttttggcctattttgattgattaatttttccttatttggggttatattttcctgctaatttgcatacctggtaattttttattatatgtgaaataatgcaaattttactttcttgggtcttgaaaaattttttgtacttctataaatattcttcagctttatctaaggacagttatttgaaaacagttttatccttttggttccagtcaggcatgactagagtaatgctgtctagggctattacttctcactactcggggaagcctcttcagtttactgtactcagtgtcccgtgatcaaagaggctttcctctcatttctagctttttgtgaccataaagaactattacctttaattctttaggcttattctttccctagcctcatttaatttccttacacacatgtacaggtcagtaccctgctgatttttcaagggaagaacttctgtataggcctggaattctctgtgttgtttggtgcttccctctcctctctgattcttcctcctgtgaacgctttggtgttgtcagactttcagctctgtttcttccactctgtgagtttcctcacttattcttcggtttctgctcactgccccatcactggaaaatctttcaaggcattaaactggaacaatatttggtctcaccttgaaaatttcacatctcacagggattactctcctttgttgcctcatgtccagtgtcttaaaatgtttgcttcaaatattttgtccatttttaattatttcaggtgggatagtaaatctggttcattatgccatcttgacaggaaatggagtttctgactcatagtaatttttatattacaagaaaaatgttttaaatgcttactttttcactttttattaagaaggctaattacctctctgcctcaattccctcatctaaaaattagaattatagttgtgcctactttcggagtggctgataaattttactgatgtaatggtataaatcactgaatagacacattgcaaacacccaataaattacttattttatcactattttatattacaaatcacatgaaacagtctttcatttgtaaatgctgtctgtccacttatattgaattcaatttctatttctattaaacaagctgaatatttgcgttatgtgcaagcaaagagtgaagtggatctactgaatgagagagaagaatcatacatcttgaaagacaggtggtaactgtgaatatagttagttgggtaaaatttcttgggagaaattgtattaaggacacttacatggtgctcaaaatgttcctctgagagtgaaattccctatccggagaaaagattcccagtaacaatttgccaagtcatttatttatgacttggatcctctcggtaccctcctgtataaaatctcctgtcaaggaagacacacatttatttccatctttctcagtaaaagttgggctgttaaaccagcagcatgggattttaacatatctctatggtatcttactcatcagttttttttaggcatgtgtcactaaaactacccactggaacacatttcaccgttccctaaggtgaaatgtagaagctacttaacagtaaatactttatgtcttatgaacttttggcaaggaaggtaattagtaacttggtatttaaaatgtccaaggaaatttatgttatataaattcttaacacagttataacatatttgacagagtttaatggaaacaatattaggcatatttcaaatcatcatagaattcagattatctacagaaaatgttgcctagtgtatggtgtgttcagctctgctgtgtctctacagaatattgagaaagggaagaaggagcgattttttaaactcaaaattaaaacagaaatttaagcatatttttatattaaagaatactttgcttaatgtacatttttaaaaacagcaaaatataaaacatagaaataaatttctaccttggatctaactagagagctcttttgccttctctacttttcttggattcagtaaaaataacaaccatttccgcatagattttatgggtactgaactgcattttctcaagaaaacattattttcttagtaaattcgcctttatatatgtatttacttctaacaaaaagaatcatagtattgttttatcaaaaagtaagcatagatgatatttattttaggatacccactaaagtaatacatagcctagtctagtctagtatagttcagaaatagtttagtaaacccttatttttccaataacccaactgtattgggtcaggaccaagtcatatctgccttctttacaatttcttctgtgttgagcaattcaatagaaatatcactttttagggtcttaatgagtaattgtcttgggggagtggcctttgacagaaaatattcagtttcttagcacatgtaatgtgaaaaattagggtatttcagattataagtaaaagctggaaatgtcttttcaaaaattatttttgttttgcaaatgctatgactagtgtcttgaacccagtagatgaaaatatctaataagatatcagaggtattatttgttgattatgtactatgtggtaggaactagatcaagcactttacggatattatttcaatgacttcttccaacaagcttataaggtattattatcctcatttcacagataaggaaactgaggttgaatggttaagaatattggccaagtagcacagaaagaattctaataatattgtctgatttcacatatagattatgttagtgactgtttcatagcacttatgtttacaaatggcttccagaaattgttcaggtagtattcgtacttaaatagtaaatcaaattaatctaccattctattggtcttaaaatcatttttctttgcatcccaaattaccattgtaaagttttcagggaagatagaatccacatattttcagcctttgttttggcagaaaaaaataggagttaaaaatttgcaatttgttcaaagtgcaaatatgctgtggcattttggcattattccaagggcacagatttaacttggaattttggtggctgttactgggaatgtactgtttatcaaattcagtgttaactgcacagttgaagattttctagcaaaactttctctttttaacactgaaaaaaattcaccaaattctaaggattgataagtaaaatccataaggagctgcagtctttaatgaacaaatcttctattaaaaagtaatcagtcaggtcattccacagagagcttgcataatcgggatttggatgatcttgggctctctactaaaagctcacggcctcacatcttaatggaaataagagaagatgaagtttatagcccttcacttatgtaatgagtgaaataaccagcaagcaaacacctgtcagatggtagtaggtgctcctgagaggtatgacaggtaataatttaatcagatgcattggtaattctatgacctgaaagggatattgtgtttccaaagcccagaattttctttcttctagataatgctgtgtccttgtgtacaaaatgacttaaaatgaaacattagaatgtagaatatattttagcctaaaatgttctttagttcttcattgctttcaggaatttctccctcctttgtgcttctaaattgttaatccatgcagatcatactaagcattatttcctttcatatattagaacaaatatctgattaagaggttattgacattaggaatcacaattctcctagccaaccacacagcgggattcaaagcttgttcatttaatgaattgttgtttagtgaaagtacatgattgtgttctcataagacactttgttccctttattattcaacagaagacaaaaaaaaaaaaaaaactacaaaatttcaaggacaattttttgcccttttagcttattatgctccctggaacatacatagaaagaggtgcatttgtttctcacaggtggatgagaattcattttatcttcttgagccaaggccctgaagaatctgattttcaccttttatttgactgggtgactgattctcttttctttacaagttggtgctgcctataccttcattcagcattttttttccccttttacctgtatttttgggattttactccccctgctggcctctggcatgcattagagttgactcttttccaacgactcctgtttctgtctgtttctcttcaaggagccgcatgtatagtacatttatgttccaaacacagcagaaacgacatgagtttaaaggtaggtattttaagttttcaggaactcatttttctcaattttttctagagagactaaagtagaccaatgctaatttagaaaatatagaaacaacattctgaatttttgaatgctaaatgtaattggtttaattacagatcattttgctaaagaaaagttatgttatggcccataatgaagaaagtttctttctccttcctaggatagcagtaattgtgctgcaaaaaacccaaaatgtttctattttaaaaatgtcttatgaattataaaacctttgaaattgatggcttgatgttgcagataaattgaactagatttcaaagtacagttaacttgacagtgctttgaaacaagggtcactcattgtcattacatctttatgactatttttatgagagaatttggataatttaactctcaaaaattgtcacatgctgttttagcttttgtagttttgcttttgttagatgtcacaaccgctattaacacaacttgcattttttcctttcatttatgttgaactaaaagatatatgtgaatattttctgggaattatttaccttagattgaagaggagagttgcagtttttacattgttcttttgctgtcattaaaagaaaaaaaatcatctgaccaggaaatagtatttttagtaaatatactctcagaatcttctccttcccatctgaaaataagatgtttttgctttttgataaggtaatggtcaatgggatcgaaagacacttttttcttccacaattacaatagacactggtatggtttattgatgattctcatcagttatatttcaccaaaatctcatagcaacaggagaaaatttcccattgtttggttgggagccagaagctgagagtgcaggtcatttttcttcatctgaggaaagtggaatagccaatccaccactttgttttctaggtctaaaatgatctgttcagtctttcctaattcatgggtgtggcattcataggagaggctggcggcacaaaggaaataagacatctatgcatcaatttctttatattgtaccatgggatgggggttttaaaagttgttcatatttgttttctgcaccatactgaatgaatatttcacagtaactctttttagaacacaatacttggtgaaaaataaaattcaccgtattaatgtaacattttccaatcctagttaccagcactgcaaagtacacaccactcaacaattgctagaatatgtagctatgtgtatttttaaagcatattataaattttcccactcttagcagaaagtgaaggaaaatgagcacttcattagcaacactcttagttgtgcagccaagaaataaaacatgaagtaaggtttctagatactatgggaaccccattatgactccctggggaggcttaggggaggatgtttttcataatgagtccatgcagaaagttttaatactagaacatccttacttagacatttgcttagatttctaccactaatgggaaaacaaaactaacaaaaacaacaactcccatgtaaattgtgtttattcctattcagttaaacaaagggatcttagaccaagttgataaactgcaacatgttcttatttattttattttatcttacgttattttattttattttttagacagagtctcagtctgttgcccaagctggaatgcaatctcggctcactgtaacctctgcctcccagatttaagtgattctcctgcttcaggctcccgagtagctggactacaaggtgtatgccaccacgcccggctaattttttgtatttttagtagagatggggttctcaaactcctgacctcagatgatccacccacctcggcctccccaagtgctgggataacaggcacgagccactgcacctggccggcagtatgtttttaatctgtatctcagtgccctctgtttttacaaagtagatgataagtattgagttttgaaatagataaagggttgacagtcatagattcttgcttttaattttaagagagaagtaggtagcaaattttggagttgaaagacggatcatgcagtaactagcaactgtttctcaaaattccctcatcattaggatctcttgaattgctggtttaaaatatcagtttctaggctgctccacaaaatattttgggtcctgcagttggacatgaaaagcacaagcaccccaggtaattcttatgatcaggagaatttgggaaacatttatctgatttaattaattatagaggcaatgtcagcgattaagaggtaagatatggagtatagattcgtatgttcatttaggaaatgcttagctatcaacacttattgagcatttatactatggaccagatttgagcacacttactacatgtgtgatttttgaacttgtcttttaccctttctgaatctcagtttctcatttaaaaaatgaggataataccttactcatggatttttgggaaggttcaattagatatgccccaagaaatgcttaatttttctgaaaaataccactgtttttaggcatctattatactgtaggggtcataatttaattatttctattaggtatttttactatacaccaagatttcattatgcaatcacacatctgttgttctgagctgtggttcttactggcatcttttggagatgtatttagaggtaaagaatcctttaacaacttttaggatccaaaatctcctaacacaaactttctccttctgccttctctttagcccttttaaaattggtgtatttcctacttaaactcacatatttcaacttcttgcaacactattaaaattacagctactatttgttaagcacttactgtaatccaggcacagtcctggatgctgcttgtattatttaatcttcacagtagtagtgcagtttaggtattatgactatttaaatggagtctgagaacacagaactcagtaattgagacagcatcttataggtatgatgctgtgaagaacagaaattattttaatacctgtatatctgtcttcaagcccaagttctgtccactataagctattcccataactttaatacagtcattttcccaatatgagaacatgaatttctcccattggcttcctaatggttttctgtcactcagagtaaaattcagcttctttacttactaaggcctacaaagcactgcaccgtatgtctttcatgttctaaggcttttgcatttgttggtccctgtgcttgaaactgtcttgccttaggtaagctgtgcacctctccctgacctcattagagatgtctttccagatgacctcccatacttgagaacatctacacacacacacacacacacacacacacacacacacacacacacacacacacacagatattgcccttcctccttgctggcttattttttctctatagcagtgatcaacagctaacatcttaacatctaatatagttttctttattttttctttctcccagtataatgttagtgcctgagaatggtagcttaatgttatctgctttatccccactgcctagcacatagcagggatgcaataaatatttgattctcaaacattgaattgggggacatatctgatattctttatgttagtaattttataattttcacagcattagaacttcatatgtgatatcttggtggttaccctaatattgtctttgttaagtatacttttctaaacaaagttcctgacaaaaaaaaaaatgtggtgttgtgttttacttttcacgccaacaggaatagcactatgcagaaaaaatatgtctttctatgtagaatatttagaataaaaggtttttggaaagatcccttactcaaataatgaagtggctattcaatattaatacttagtatatttcagttgttctttgctttggaaattagggctttggaacatatgtgagaattaggtattacttcagtattaggaggtcttctacttgctgacagaatacttcgtttgtgccagttctggccatcattcattattattaatagtagtatataagcatggtaatgctaattcaataggttttccaggttttttctccctcttgttattatcttttattttgaagtttgcctttatttcaagttgtatttgtgggtattcagaattattgtacctgtgtataactcagtggttcaaaagtcattagtctttaataaattagaatttattttaaaaattcaagatctgaaaacatcatttcattgactctcaagtaatgttaatgccaagttttgaaaagcaatttttctttttggaggcagtaattttgagtaattggattccatgaaaaaaatggattcaggagctaattgtgtaccaggtttactggcatttgtgcaaaacaacatttagcaactgtcagtgacaatactcatctaatttctctttatcaccagctggtcaatcacgtatcttcatcaatacaagtattttaatttcctctttcaggtatcctctttgtgtgttttcttccttctcactctcccttctctccttattttaagctactttagaaaatagtaatactttactgatgtgtaagatgcaaatcactttggaagtgagaaggtggatatttatacatttgttctatgacggggtttctaagtctgtcccactgggaatggttagtacattccatagctgtaagggaaaaatccacttttcccagaaataaaggtcaagagacatggaacaactcttttattatttgctttcaaaacagagggaatatgatttatgtcgaatataagcttatgtcatagctgtgcaggtgctgccgtgaagctgtgacccctgtctaatccccataacgacactgggcattgaccacatttgctttgtagttactgagctgctttcccaggggccttctagtttctgaacccagccgctgggtagctggtcgacccgtgcttggtgcaagaacattgttttgtaagtgcaacctgaaatacattttataacccctgcctaagttaaatgactgtaggtctgtgacggagcctctgtgattgaatcaaagtctcctcttaactcctttttttccttcatgaatttagtagtcggctgtaaatagttttttctgctttattttttattgcgttaaacataatcacaatgatttatttcaaaaacactaaacagttgcttgatatttacaagataaaatgtaatactgactttaatacatcattgcctgatttacttatataatttttatttatcgttgtaagatagttaacatttttccatgttgcttcaatatttttccccttaaagattaatgacttggtaaaatttgcagtaatcacacaaaaaatttgttttccaatttcattctgtcttccaacattttgatctcccagagttttaatattttttaagtttcctatgtgttatgaattgtaaaataaaacaaaaatcccccaaaacaaaaaaagacagctatattaaaagtatcaactttattttaaatcttattaatgctttttataatgggagggaagatatatatatttaaatgaccatgtaaagcaaagtgaggaagttaggaaccaggacgctgaagctaaactgaagttgaatctcagctctatcatgtcccagctctgtgattttgttaatctctcaaaatctgcctcatctgtaaaaaaaggtgaatgatagtaaaactatctgttgcatagctgttgtgattattaaatgagttagcatttgcaaagccctacataaatatttgctgtgtagataatgtttaattttgtcaagaacttttaaaagatgtgttttgagtcattcatacaggcacacacacaggttattacaattttatcaagaaattattagccttgtcttaaatctcaaaaaatttgaattgacggtgaatatgtggaaagtgacaatatacaaggttatccactattggaaggtgtgtgtggaacagaacagaactagatcacatagctgtggagaacaaaagctcaagaagaaaaaaattcaaaatgagtttatatttttctcacaataactgtgggcacccttcaagcttcagttaagtgatgacaacataattagacagtaaaatattctgtttctgaactgttctttgtgtgaccttcagttatctctgaggatcctcaggtttcttaaggtttccttaggctgtctgtttaatctgatttttctgaaaaatgtacatgaataaataggccctccaaccaaaaatattaatatttaacatttagccaaagaggtagcaaatattattttcaaacaaaatgaagtaagatagaagagctgagacaatataatattctgcttagagggaaacagtaggttgccactgatttttagtcctgtgttttgaaaactatttgagatagaaggactaaaattgcaatgaagattactgcaacacagttacttggtcctcctatcattaattgattaaaggtaattgccagggagtcacctctggagggcagtgcagtcttatatttgttgcaggagctccaggtacctttaaattttccagaagttcatttcaaagattcttggccttgtgagatgtgagtcattccccgttttaaatactcaaagggaacgtaaaggtgaaaacaaactctttttcgttatgatggttagcatgctagattcagggaaaatgacgggaaataggacttaccatatagagttagtgaatctcggtgtgcaaataaggagctggctgatgtttgtttttttccccccttttccccactttggttcagatacttgtgaacctccatttcatgatccttgtttttgtctctgtcttactctaaaatacaaatctgtatcttctaagaaaatcttttaacagcctcaccatatagggtgttgcagaaggtcagctcggcggccagcaaaatatcttccagtaccttaacaaatcagcaaaatattttgagaaatgctttacttttatgaacaaataccctgctagttattggatttgtcatagcatctaaggtttctctcataaccatactgaccttcatgtgctattgtattacaaaaccaactctttatgtaatcaaacctaaggaagaatgcttaattagctatacatgaccctgtgttatgatacaggcatacaaaagttattttcttcagcactatctagctattgtacaaagaaacttctttataaagtaagacatgggatatttgatgtctcaggagtaaagtaatattgggatttttttttttcctctgcaagctgtttgagagctttcagcagggggataccgtatttaaaggtagcctaagatctcataactccatgtgtcacaaaaactgtgtaggttatgaaagacttttctcgtgagcaaaacaactgtgctttttagctctaaatcatgacatagtcttgttataccacaaagaattaaagaatgttaagtaaatgactttcttccctccctctgtgcctctgaggatagttattaatgccgattcttgctgctgagtgatcctgaagctactgtggcaacctttttattccctgagtgcaaatgaatcctctatgaggtaattgaaggaaattgatgacattatttgctgtatcttgggtatcaacagcatataaatgaaaaacacagcagaatgcctggcctgtgttaccacattgacctacacatttggatctgaaagatctcgagctattttctgcctaagcagactttgcacctttgtgttttatagtgaagtagcaggtacacaactttttaaaatcatgaactcctagcattggattaccaccacctggtgtaagggataggttttatagaaacacaaagagcatggacttattcttttcatttttgttcttctttgccaattttaatgttatcttcacaatctgaacagtgtgacctgtttcaccttcttttattttgaatgttagtgtatgcacattctaagccaagggtggctttaccctttaagttaaattaaaccatttgggacttagcaaattctgggttgtatgttttaaggtgaaaaaaaagcactaaaaagaaaatttaaaagaaattttatcatcatatagggtgtggatgaatgattcaaatagaaaacctattttaaatcagccctactgaatgaactatactaaaaggacatttatttacctagttagggaaaaaagtcactttaaatatggtctctagttacttttcttcccatttattacatttgccacttcattgtgaccttactatgaccttgtagtttatgggctaaaggtaaccattatgcaataatgaaaatatgcaggccagtctttaccaccttgaaaaaattggtttcttatattttgtttaaattaacacactttgctatttataaagctctgctctacggtgcttgaaagaggagagaagaattaatcgcaactaatgtgcagatttaggcttttagagactgtgtttagtggaggtgagtcagcaggccttgttatattaattatagtggtttgattctctactggttttgattcacagagatatgcgctgtacgtaagaattaaagcatcaattgcttaggagaaaaaggaacttaaaaatcaaaccattaatacctatctttgctttcttcttttgtctaatttgttttattttagttatccaggcccagatttcctccactttccctttgccttgatcccaaaacctgacctctgtgaaaaaggcaattcatcaattggatgtggtgagggaaatgcccttcagaaggatctaaaacaggcaatacaaaaagctttagacagtcaacacatcggggcacgtaagctctgatgtgacttgttatctctgagaccagtgtttgcattcttcctggtttgttccttaggcttggaaatgcactgaaaccacagctggtcttgaagagccatagaggatgtgatacaaggaatgataaattaataattacagatcctcaatctgcttattgtcagtcattttttctaccaccagttacaaatccagtctttattctcaaacagaagtgatgataattatccttggtaaaataactttcacataatgttgattgcagacagtcaccaagggctatgctccaagtacacttctcaccatttttatacatgaaataaaaactcttattatctccacttgtccatgaggaaaccaatgtacagagaaattaagtacccttctcagggttacacagaaattcaagagctggatttttaccacaaaggatggtttagagcctctggtcttaaccttccaagagtctgggttcttgggaatcttcattttcaacataggctctttatactaccagaactagcatgttcttcagatattcaaaacggagacttttaataagttcattattaaagaagtgaataatttaggattaaaaaaattctgttaaaaatgggttgctcataattaatgaaggcagatatttaaaccatgaatcctttataaaaccttgggatgtgaaagcttattttgaaatggactgttggactgcatgctaaaagtatacccagagtgaattttcagagacattagagacaaatttaacatcaccctcaaatctgtggaaggttaaatatacagagtgtgagacattgagaattaggcatttacaggtacttttccccagagtttggtttggtgagggatttaacccccatttcgtgacactgatcaaggcaggacattttgaaggaaaagcactacaaaaaggaggaattgccttgtcatgttatgaagcatttaattctaaacttctctgttttaaaaacaaaagaggcctatctatagataaacaaagtagactcgtgatttccaagggctggggcaggaatgggtgggtattagccataaactggctagagggatcttactgcaagcgattgaaatgttccaaaattggattatagtgatcattgtacaatctggtttaaatgaactttgaaatcattgaattgtaccctttaaatgaccaaatttatggtatctaaatataccttagtaaagtcatttttaaaaatgcatgtaaaaaaactaaaaaagaaaaaaaggaagatccagaattgggtcttcagacagaatcattatttgcatcaaattcagaatttcccgtacatgatattaatttacttctctaatttgaagtatgacactaaatgtaacacgttaggtcatacatttggcaaagacaaattcttcctgcctgtactttttcctttcagtttttaataggtggcgccattattctttgtagcctctagagggcagcacataggtttttttttttttttttttttttttttaaagacaacaaacttgtaactcccaagcatcaagaatgcccagttgtttcagatgaactctccaattttagttcatcctgacgacctcacagtggaggaccttcctatagtgactcctgcgaatgaatcctcccttccttcctgttagttgctccctttcacctctggctatttaatgtccttgaaagatctttcagctctctctacaggggaacataggagtaatttcagttgaaactttcacaacctttttcctttagagagcttgatttttaggtaaagacaatagtcagttaatgaataaaaccggtatttgcacatgggggagggttgatgcccaggagattgtcataagaattcctgacacaagttcttcagatcgcatcggaagaatccggctatgccaaaagataaatgtagagttctcctcaatgtatgaataactagggatgcaggatttaaaatctataagaatttttaaagttgtaagacataagcatcctggtgtgttttttgattgttgttcttttcatttaattatttattattagtttatgtacagtagaagccaacaaataagggttggaaaggtaaattaactagcattaaggtatatactgaaagtcattttaagaaatgccttacctcttctcatccccacgattaatggcattttccctatgatcattgaattttaaaaatacctggaaatttataccattctaggatcttatagaatcttataggatttattggagttgattttagtgtaggagcctgaaacagttttaggtccccctcactatgtcttattgttacttcgtttctgacattcttcctatatatccaatctaatatatatgtgaaaaagggtagacatcaatcagtattaagaaacaatgagaaatgcctgaacagacctttaagctgtgatttaaaaaaatcgtatttgggtgatcctagcagttaaattgactttttctttccttctgtcgtctctgttctccttttttttcctcagtaaactttgattgcttgctaattgtgtgctaggccttgtttggttgtttattgagagaaagaaataaaggagaagggagagaacacaaacacaatttctgcccttgtggaattatagccagtataggagacagacaaaacagtatataaacaaaaaataacaatacataattacagattgaaatcaattctaagaaaaaaaaggtcagtaagtatatataacctttggggccaactttaggctagagagttaggaaagaatttctgaggaggtgaacttaggtggccctaccacataaaggattgggcaaagggttatccaggcagaggaacagagtatgagaaggccctgagtcaggaaggagcatggcttgttgcagaaactgaactagtgtctcagtgtttcactgtgaatcaagaagtaagctaggatgtggcttggggaggtaactggccaggactgaaagatctttgtgaggagcttggatttgtttctaggttgagtgatgcctccagagggcaaaagaaaaacagcaacattatctgattttgcttttgataggattattctggtttctctatggagattggattggagaggggctcatatgaatgtggcagaagtttagaaggtgtagctgggtgtggtggtgggcacctgtaatcccagctactcgggaggctgacgcaggagcatcacttgaaccccggaggcagaggttgcagtgagctgagatggtgccatgcattccagcctgggcaacagagagatactccatctcaaaaacaaagcaaaacaaaacaacaacaaagaagtttagaaggtggttgtgatctagacaaaaatgctcttgcaactgagtttcacctgcaatttaggaatgggaagtaatgtgttgagtccactgatgttgggagcacaaacacttatgtaggaggtagaagaaacagttttttttcctataaagttataaatagcttttagcttattaggtgtggctatgttgagacagtagttaatgattagtgggatatttaaaagtgattttggaaacatgaatatcttgtgatttttattttatgcaaactggcattgattttaaaagctgaggcaatttaagcaacttcgaatgagtgttttctctctgagggttggaatttggaaaaaattgaaatatgggagcagatgagaacatgaagaacttgataagtatacctacatatcctttgatatcattgttaggaacttatcttttaatcgaatgcatggtgccataggttattccttctctatatcacttagtacttaagaacacaaaactagacattagtagaatttacagatacacatttgattcctggctttaccacttactctagctataactttagacacctgtcccctcactgatatttctgaactggaaaattgaggtataataaccacgttagaagaatgtggtgaggattatgtgaaaaaatttatgcaaagtacctgtcacatagtcagtagtattcaattaataccagattaggtgatttgccatgatttgcccaaggacaacagctaataaatcgtaggactaatatttcaacccagaaggccttatgctaaaacctgcactgttcatcactgcccagtacttctttcttaaattggggcagtgaggccgggcacagtggctcacgcctgtaatcccagcactttgggaggctgagacaggcagattacatgatgtcaggagttcaatatcggcccagacaacatggcaaaaccccatctctactagaaatacaaaaggtagccgggcgtggtggtgcacacccagcaacttgggaggctgaggcaggagaatcacttgaacctgggaggcagaggttgcagtgagccaatatcgcaccattgcactccagcccgggcaacggagtgagactctgtctaaaataaaataaaataaattaaatagtaaattgtggcagtgaagggacaaggagggaaggatatttgctgttgtcccaaactatcttcttacttcttttcttccactaacctgcttttcctcaactctcattcacattttctaaaacttgagaatgaaaaattcaaaattgcataaaagtagagcaaatagtacaatgaacttgcatgtaactgtagtccccagcacctgctttgtgtctccagggacccagcaaggttgctttggtgattttttttgttgagatggaatctcattctgtcacccaggctggagtgcagtggcacactctcagctcactgtaacctctgcctcatgagttcaagcaattctcctgcctcagcctcccgagtagctgggaccacaggcacgcaccaccgtgcccagctaacttttgtatttttagtagagacagggtttcaccatgttgggcagggtagtcttgaactcctgacctcaggtgatccgcccacctcggcctcccaaagtgctgagaatacaggtgtgagccaccgtgcctggccacttcggtgattttctaaccacactgaagggcattttcttaaccctcattttcctctgcagttagggctcctgctgacaccaccttctgctctgccttagcattgccacaggacacggttacctcaccttccaccctccgattctcctctctaaacccctcacttcttgctcttctgctcttcttgttctagattgttttcagaaagtttttatggtttcttggactcaactataattgtaattaagagattaatctccagtcctaacctcttatcctatgtatattcctacattttcaattacttttaaacatttatggcaaaactcatatctgccaccaagtggatggacttcctttgtgccatcatttttctagtttacataagtgaaatgttcaagtttttcctctgtactgtcgtactccttcagtcatttagacccaatgtcctttggtaatatttttcagtatcttctccttattttattttcctttttctagaaacatgcatcaaccttatgacttgttatcctcattttaatcttttcccctacactttctgaacatctctttagccataaatttccagaggcctctccatttgctgtggaaaaaaaggagaatttaagaattaccgtttcaagtgcttttcctctcactgttactttaataaattcttttcatctttcaaggtccacttcaatctcatctcctttttgaagatttccatattctttcctcaaagagtaatatattcctttcatttagttactacagcactcttggcaccactcatttcaaaattattatgtagtacattgctgacaattttttttatttgtcttgttataccagtaaaaatgtttactttccaagagttgacatttttttatacttacttactttcagtgtctagagcatttgtttatacataatagttgaatgattgattttcatactagacaaataatgatcaatgggtaaattaattagcagtaagttatatacctgaaaattatttaaagaaatggcagaataattacccttgtctgggatcagttttgtaacatgccacagttaaggggcaaattttcagttcattaagcttcttccaaaagagcctagtttcagaatggaatggtgtttctcctcttctgagaattataagaaagtgctttagctagcaaattttttttttcctcccaggtggttctttgtctacataccatccaactatgaacaataatgtattttatagactatactaagatattgaaagttggagagatgtattcctttgtctgatcaaacctagcaaggagaaaaactgggttttcttctcctaaaatattaaattccaaaaattacaggtactcattaaaaatctcaaacaatacataagtaagtgaaagtaaatggtgatgaaagcctcttatccacccacacctctctcctgaagttacctagaccactgctttcagttcatttcaaacatctaatctattgcatgtcgatttatttgggtagtattcactgccttccctaccccttctttaccactgcacctcaagaagacctgaaaacctttaaattgaaatttaattatttcaatttaaacattcttattctgtatatttggtaaataattatattcacttatattacaccagggaaaccaaaggaaacattcatttctctttctttagaaacattttaactgactcaataggcataaaattttactgagggttagatttctgttgaatatatggttaattctacttctgtttaaggaaaagaccttaactttaattcatagagcaatgctgttgcaaatgtgtaattttccaaattgtccatagtccacaaaacactttaatgtattatttcgtttattgcaaggagagagagaaaaaaaaaaacattctggcataaagccaactaattactgatacactcaggagactcaccgtcagtacatgatatgctattttcctccaagtgttccttatttcttcccttctctccttgccagctccccgcccttctggaatttcttggttcaaggacaagtgctgactcagcatgggccaccttcttaggctaacttactgctttccctgctcctaaggagtcaccagagggggagcaaatggagcaccagcacattctccaattctcctaggtgtcgtagctctcctcactgattatgaattgtttctgggagaacagaatgagctgttaggctgcaaatgatctaacctttcatacttgaccatgtagactttccgcatttattccagtcctcatttccaaatttcactaacagaattgcagagatcgtaggattctattgtcacagaatagaaatctgtgatgcttatgtgttgcaaacctaatttctctatatatttgtgttagaggaaagttatatttttctattatctttgtagaagaactttggtttttaacaatcatggtaacttaaaaacaagtttcttggtaacttagatgatccagtcattaaaatcatgatatagattctaaatattggggaatttggagatttatgattcttaaaggcattataaaaaataaataggtatatggtatacagttctaaatagcttggaattatgagtgtaaatgttaagtgtactagcagtgatttctctttaaaaaataagcaaaaattgaccctggattgatgaaattttttttaacccttattcatgttgtaggaaattttatagacagacattgtaaaagagtgaatggattgctattgaaagataatctgatatcaacttaacttgctggtgactttaaatttcatatactggctttcatgctacatttatatcttagcaataagtattcatgagtctcatatttgaaggtagagaatcttgaatagtaaagagttctggtttacgtctttaaaggtcagaaatatgcactgttatatctagtttgtatatttcctctagtaaaaatctatgcctgactgaaagtgctgaatttatggtagaacaaaagagacttatcccacccagattgattcaaatacctggagataccagtttcagacatgtgttgatacagcttattaaaatagtaaactcactaataagcatttttgtattttggattgattaaagaatgtttatgtcaagaaaagcatattttgaaagtaattacaaccattagttataattaattcggtttatcttttttaaggaaggctaggatttaataaggtgggttttcctaaagcctttaatccatggcttttattttcaccacggtagattttccatataatttccctccttactttttcttaatgtcagatgaggtatatatatcttttgtaacttcctggtgtctgatcttagatacttctaaagctgattgtgaggattaatggacagggattctatccagtaattgtgggttttagaagaaacatactcatcctagagaaagaactggcacacatttgcccatttttgtagaatttggcctagattcgcaaagaaaaaaataaattttggagacttctgatggttcattttcttaagaaagaaagaaaatgttgttattattatttgcatttggtactgtgctatgtaaataaatcagtggcatctaagttagacttgattttgaagtgctgttattgattcactaagaaccactaagtttctccatctgcttcctatttacaaaatggagatgttttctgtttctaatttgcccctcagaagtgcagtgttataaggattaattagagaaagccaatgggctgaacagtgaggaagacataaatagagacaaacggggacattaccaggtgcctcctctttttgttcatggttgatcttcaatctcaatttttttatacaaagggcatctcattgtattatttggtccaatgacttgcattgaaaggatactgactgccccagaattcatttgcttttcttagtgaaatgccttaacattaatatttttcagggtctaacttttcctaaagattttcaggtcccagaatttcattctgaatggttgggctttatcagattatttttcaatagcaagccattcactcttttacaatgtctatctataaaatttcccacaatagttcataatcctcttttcagcagccttttctccttctttatcacttcttttgtccacttattttcaggatgcaaagttggcgtcactgacttgctcatggcttcttgaacatctgtgtgaggcaggattgctgaagatcccaggcttttgagttaaactgcctggggctgaatccctgttctaatctggctgtgcagtgttagtaatggtacctccatttaaccatctttaaagcgaaaaatttctcatggattcctgtgaggattaagataatataaggtctgcggcaccggcatatgataaatgctcaaaatagtactattacttgtattaacattagaaataaacatttaggcacaaggaaggaaaaaataagcaatcaggaggaagaaaaagagcagtcagaaaatggtgagaattagcatggggtgtgttttgaaagtaaagaagaagagacagtcattcgaaaatagagaattttctatacctttgctactcagaatggctcctggaccagcagcatgggcaccctggaagctttccagaaattcagaatctcaggcccccaaagccccaggaatctaaatctgcattttaacaaaatccccaggagattcattttaaagcttgagaaggcctggtctacaacctaacatgcagcagagttgacagatgagattaagactaaacaaaccttcgaattttcctgctagacctttagtggagaaaacagggaggaatgaataggtggcaaataaaagagagaaatcaggtattgataattctttcaggaagctcaaaaattaatcagggtgaaaaaacgttagataatacctttaaaatgtagcagaatcgaagggaaatttatttttatgaacaagaaaaagttgagtctgtgtgcaggtggagctgaagtgtcacacagggtaaaagattgaaaagtaatgaatacatgaagacatggatagctaagagatggggcaaagagtgtttgaaaaacattgacagctggtaagtttcagaaaaacaccttcatagactagtgcaaagatggaaagagtgaggtcaataagagagaagatatgtaattaggtgtcttcagggctgtttgctgggagtaagtagggcaggaatgttattggtagctgatgttttgatagggttagaaccactttggtgagtgagatagaactagagttgtaaataaattttagatctagtgtgaactctgataggtcggagctgcatggaatattgtgttgagaaggcttctgaggccaacataatattaacagataagagctatgtatgtcatgagcagttcctggcattataattagggagacatagtagtgtatgctctgcacattcaccatccctggtataaaggatctcctggccttgtatgaaattattgagtagaaataaagaactataacatgaaagtgtgatgaatcatttttgcagtattttgtcttctttctccaataatccttagcctaggaatagaaaatacagacaagggactaacgagcagtaataagcttatttttgaaaggcttgacttttatagtctttatgacttttttttttaataaaaaagcaaataaagcctacatttgaacaattttatgttttaaaaagtgtgggctcttgtatagaacagactatggaatttgaacatcacatctactactttttagctatgcctttgggcaaattatagttaagcattttctagaatgaaaaactcagttttctgagtttaatattagtagtaataataactaatagtaatttccaaatagagttgaagagaagattaaatgaatgtaacatcatgcctgatgaattcttctgctggttacttttatcctttagtgttgttttcagttgtttttttttttctgtcaatttcttctctattaaaaattgttttctgtcaccacgcaaagcaaccaggaatcatagattatggttgaaaaatcaaatggcaggctatttgaaaaatatttatttcaaaattttatttgaaaaaattccccactgctataatttaatgcttattcctaatctccttaatttccgttgctttatgtattatatagagataaggtggagggaaactgatcatgggtgatgataactgcagaactgctgtaagcaaggcttgttcagaaactgacaaatctattacaaagtgactcatggaagtggaggttctgtcacaaacagggtcagttattacttggcagtattctgtgtgctttagaagaaaataatgggctgacatagcatagaactttgggaataaaagtttctggatcatggcagttggcccaggacaccagacctagaatttgcaccggtagaatttgtctgccccaaagtaactggcaataatgccaatcaagacttgtgcctactcttccatgggttctggtccttcagtcacatttggccaggaaccttcttggctgatgaacttttatatggatacactataaaagagcacagctgagagccaaggagtgggatgcattaattccataaccacattttttctttatccttcaaaaaatttgagaatatatgacactgacagatgacatttttttggcagtgctgttaggtctttgctacaaggcagttctccatctttgtagttgcagagttataacttggtttctaaaagaaatcctcatagctattcacctggctcatatttcattctcagcttgaaattcaaatgtattgactctcctatttttatgtaaagtgatgcgtttagttagattgtcacatcttctatatattgtgtacttaatcagtttagtaagaaaaaaatctatagaaaatgctttggatgaagtatgcctattaaaatctcctacatttggctagttttattaacatgcaattcttaatatgtagcattcactacctttctatataactagtttctcattctcttcccatctgtatgagattttttcattttctttcagaatatacatcaaaataatgcttttgtttctttttcacaagtaatagatgttcatatcagaataatgaaaaggcacagataagtaaatagaagaaatacaatcatatttaattccatcattccaagaaagccattgttaattccagtgcattctaaggggttgcaaactcagatgcatagagaaggccagttgatatgataaatgtacaaatcaagctggatgggagccatgggactagtccttgcaagcatgtgggcctggggtcccctgttcttcctatttttcaggagaagaagggtatcagatttttatataacacatctgatattgaaatttgaacgtgataaaaattggtaaagactctgtagaaaccaaacagaataggtatgcacaccttttgctttgttccttttgtatatataaactataatgttagaaattacaatggtgtttgcatttcttcatttttaactgcactttaatatttcttccttgaataaatgacatttgcttatctcatttcctcttgataggcatttacattgttttaggctttgctattatggcaatcattttctgaacatgcttgtgcatgttttctggtacatgtatgggtataaggtatattggaagtggaattgctgagctaagtcatagggtgggtacatgttcaactgtgtaagataattccaagttattttggaagatgtttgaaaccaatgtatatgcccatcagcagcctatgaaggctgctagtgtttcccatgtttcccaacacttgtatgtttagattttttcatttttgtcgtttggagaatgttcgtgtgatcatttgcactttcctgattagcatgaggttgagtatcttttgaaacttattgatttgatacttattcaacatagtgtttcgacttatgggaaatgcttgctttgtctactttcttttgaattgtttctatcttttgttgacttatggaagtcattgtaataatttgatactaatcccgtgtcaattttattaccaatatcttttcccagattgcatatcatcctttcacttccttttagtgtcattgataaatggaagctttctttttgatggattcaaactttttttttaactaaacagttaatactttttaatgtcttgtttgaaatttcctatgaaaggtcataaagatatcctcccatattttattctaagatgaaagtgatctatcactttaccttttaatccatctgggatttttttgtgtttggtatgaggtgcagatccagtttcatttttgttttccatatggttagccaagtatccctgactaaccggtgatcggcagtgccactattgccatatatcaaatttcttatatatcaaacatgctgtttctgtttctgaactctgtttggttccattgctgagacctttgcttctcatgtacactatgtttatagagcaaaacatattgttttgctaaaccgtgctttattttctgggaaaaaaaacccccaaggtttatattaattttatgaaaaaatggctgtcagtttattttataccttttcccatctgcccctttatgctgattataaggattaaccctttccattatctaagctttatgatgatccacttgagtaatattggaaaagaaggaacaacatgtccaggtttcagacacatgctcagtgaggcaaaatggaatacagaaattcctacctaagtagtagccaagtcaaagagagaaatgcctctctgtggtgcccctgagaaggaacaggggttgtaactgatgaactcactatgtaggccacagcctgatgcttgaatatattgctgataaaaatccttataaatatctagatagtgattgtaaattaaacttgtattccatctgctattagtttaaaatctactaaacccatttttcagcctgtgaaaaatataccacctggccaagtgctttcacattatttatgtatggggcatttagggttttcttatatcttttttccttttgctctacttcaggatcttttatatgtttaaagtgaaaagtatttccacatatctctatttaaaataatttagtagatccttctatgtctatttttttgaattagaaatgcaattctggattgttgtaaatgaattatttgagtctgttttgtctcaatgtaacagcagaatagtggaattcgtatggaaataattgttttacacttaaaaaattcttttagtgacctcaaattcaagaaaaaagaaattaactgtatcattattttctatagtggtatttaaaatattgtaataacatgcttaccatgttctctgaaagtgaaccaagagagttatattgcagatctattctctgttttttctcctctgtttctttaccttttctttttcctttttttctttctcctcccttttttcttctcttttaaatatttgtaaattaatgtccttacctggaaatcctgggaatattttatcttgagcttgatatctgggctttatttaatgactcctttagtggaatttctaactataaatgaaatacattttccctaaatgctgtggactttgcagtacaggaggccgattaggtcaagatatctactattgtttttctatatgtcagaaacagtgtttcaaggttcagcaagtcatgaaaagtgtttcaaggtccatcaaggagagactcagagggatgattgaggaggtgtgcgctcactgtgtctgtccctgccatcatctccaaatgggattgtttgcatccgtgtaactgctgctctgaggggaaataaagtttatagagaatctttaaattattccagtgtaggaaaaaattgtaaggtcaactttctcatcacctgccaatgcaataatttttttttgtaggttgaaagcatattcaagaagagtttttttaaaaagatgtttaagacttacttttccagttctttttttgtaactacaaacagaacttgtcagtagaggtaatgatacagaaagggaaagaagtatgaattttaaatgaatggagcgcaggctattaagaaagtaaatttattcgtgcaaaccattgtgcatgtattctataggttattccagccccaactgggttaccttctccctgtactcactagcaatccagtcagtgtggttctagttagaatcccataaatctgtaacagaattaattgcatatccttccaagctagcagtgaaaggagtaacattggccaggattttgatgttttgccatattctaaaatcaacatgatggtatacgacattgctgaaaacattaatttagagggtggctggaaattgctgaaaatattgaactctagctagtgaacccaaacattctcctttttttctacttctagatcagagaagtccatgtagttaaaacttcactcttaatttaattctctacctcaagtatatatgcataaaaccatatttctttgtttagcaagctgaacactgctttttataatattagtctgtaaatcataagtgtgaggcaattggatcattgtgctctgtaaggagcatattccacaatagccagtttattttatttgacttttatctagcccttgctagcaatatactggattctgtttgatgcattttgcataagggttctatttggtccataatggtttgtgtaatgaactatttgttctcttctagatgacagccagttgcttaaaacctataatgagatgtcaggtgaattgcactgattggcattgatggatggacttgttgaaatattgcagagtttccgtaggggcgtagaggaaaatggctgtttagaggtttgggtctcctaagcactgaaactgtcatcacataaacagaaccacttctgcaggtctgaggtgtcatcgtgcattttctggctaatctatccattcatctcaatagtccagaactcgcgcatcatgtcactctttgcctttgttctgcactttgatctttcagaatgtctgtcagaagaaaagtgtttatattgaattatgtgtggaaaggggtaggctgcatacttcagaatcttggcatgaaatttgctaaacaaaccttgccagttgctccgcagcaataatcgaagtatggatttcaatttaacgatatgtaggtgcacacttttccccttcaaaaacaactttaatgtggatgtttgggtgtaggagattttattttgttttgtttttcctgtagaaagtatgtagcacctttattgttaactgttaaaattaatgttaagaaggaagataaatgaatttttcaaaatcaacttttttccactaaaattctggttaaatgcattaactaaatgtatgccttggctgaaatatctttttgtgtgtatattttatctcactgattctaacattctagtataagatagtctattttggtatccattatatctattataatacatgtattagaacacattaggaattccacagcaaaagcaaaagcaaacaaaaataggaactaattacattgaaaagtactatacagacacaatagcagaaacaatgggtgaattattagtttctgcattctgtcacagctatccattctcttttctcatacctttttaatatgtttgaaataaaaaataattatgagatcaaggtttttttccttcatagttgtctaaaatgattaaggacatcaatttccactgatatgatgctgtgggcaagaaaatgtataatggttcaattccccaggttaacttgccttgcagtgggcaaaaacagacttcagagatcttttgacattggtcatatgtctttcctcagtctggagatggaagttttggtgctcttaactgctatatcctgggcttctcgaggtaatgacagatcttatgctaacttagggaccctttggattaaaattgaatagtaacctgcaatgacatggatgatctttgaatcaataactttcttactacaaatgaagcattcatggaagctgaatgagctcagctaacccagtaaggtaactcacattcaacaaactgatttggtctttgacaaggctcaagtgtgagtagttctgaaagtttcccaggtgattccaatgtgcaagccaagttcaaagccactgagctaggcagattgaacagaatcattgcaactgtatgaatatgaagctttccaggcagaatgaaatacatggacactcatgagaatctagagctagctggtctaccaagggcttctcaaacctgcaaaccaagccctgctgatctaccaagagcttctcaaacctccaaaccaggacaggcatggcaggaagagggttgaaccacagcagagagctggtgagacaaggtagtctgttttccaggactgtattttcccttaagtgaagaccacgtcagatgttaaatgaagactatgaccctttaaaggctttggcttgcttagtatagacacttcttcccactcctagtgtcattcttgaatggtttaaaatatgttgatagaagagtaagaggggcagagctgttattattttctgcaaatttttaaacatgagaacatcacgacagtgtccctaggattataagctaggcccagacctagtctagtctgtgatctaccagggttgacagaaaaaagctttttgactagctgaacagcttctggcagacttggttgtgtttgatggcatttatggtgatgtcagtgatgccatggtagtgactggctgttacagattgtaaaaaggacaaggcatttggtacaggcaaacagaggtattaaccatataacagatttctctattcataacaatggttacttttaataaactggaaattgcatgtttagtcatttgtctgatacttgttcagacttggagtcaaaagacttgagttttttagcctcattttgtaattttaataattatttttactattcactatattctaactttttactagtatcaataaattaatatctcccccattatttttacaagtacttaggttaaatatctaattatagagtgcttttcatatttttaaaaatatcaactgtcaaccacaaaaagaactggagtcacaagtataagtctactgtaagtatactgctatgtatttgtagtaatttctagctgagcactaacgagtaagaaaaggtggtgtagtaagaaaaggtgggtgggtatgtttcttcatttatttcaagttatagtttatgtaaagttcatatggttttagaacatttttattgaggacctctggtatatgttaccttaaaaaaaaggatagcttaagtatccttcatttattcatctgtaaaacaggggataataatagtgactgcatatgggattattacaatacaaaaagatgtatatttggagggtcttagcaatgacagtgaaaactattttgttgagctttgtgtccaagtaattcagacatcctgatgaactttctttttgtttgaatattgaaaacatttttctactttaatgggatttcataataggttagagattccatgccaggaattgaggtgtaaatgccacatttgcaatgctacttcccttgaaatccaggtgaaactaaagaagctttgaaggaaacatgacaaaacttaaactcttcaggtaacccttcttttctaatcattgacattttttaggttgctttgatattttgttttggaaaaaaatgataatatattttttctggcatttaagtcatgctaacttttaaagagaaacagtagacttatacttgtgactccagttttttttgtggttgacatttgatatttttagaaatagaaaagcactctataattagatatttaatctaagtacttctaaaaataatgggggagatattaatttattgatactgtaaaaaatgttacaatatggtgaatataaaaattattgaaatcacaaaatggagttaaaatgtcactagttccctctcggatgtgtttcttttacattgaaaaaatgcttattcactaaatcatactatgcatatatatcataaaaatatagcttaaccgtatcatatatactagatatatgtagtacatgcataaatctagtgtgtatgtatgtgtgtatatatatatatatatatacacacacacatatataggtacagtttagaagttatatatatatgtagtgtaggtgtaggtgtgtgtatatatagttttgaatgtatacacacaaatacacagatgcgttgttgactgggataggttctgataaatacatggttaggtgatttcctcattgtgtgaacatcttagagagcacttacaacacaagcctagagagtatagcctactacacacctaggctatatggtatagtctgttgctcctaggctacaaacctgtacagcatgttactgtatggcatacttcaggcaattgtaaaacaatggtaagtatttctgtatctaggcatagaaaaggtaatgcatttggctacaacattaaaatggctacaacatcactaggttataggaatttttcagctccataaaaatcttatgggaccactgtatatgtgttcagtcattgactgaaacattgttatgctgggtgtctccagacctcttaaagtctttatatatataaaatatataaagtctatatatttagatcctctgctgttggcagcataatatacagtcatgtgctgcataacaatgtttgggtcaatgacagatggtatgtacaacagtggtcccataagattataatggagctgaaaagttcctattgcctggtgctattaagctgtcctaatgtcatagtgtaaagcattcctcacgtgttttttggtgatggtggtgtaaacaagcctaatctgccagttgcataaaagcctagcacatatagttatgtacaacacatatcacttgataataattatgttactggtttatgtatttactatactattaatcattattttaaaatgtggttatgtaaacaaagttaattgtaaacagcctcaggctggtccttcagaaggagatgatagcttcatgcatgttactacataaaattgtttgggataataaataagataacttggctgggtgaggcggctcacgcctggaatcccagcactttgggaggctgaggcaggcggattacctcagttcaggagtttgagaccagcctgaccaacatggtgaaaccccatctctactaaaaatacaaaaattagctgggcatggtggcacatgcttgtaatcccagtactcaggaggctgaggcaggagaattgcttgaacccgggaggtggaggttgcagtgagccgagatcacgccactgcgctccagcctgggcgacggagctagactccatctcaaaacaacaacaacaacaaaaaaaaaacaaaagagaatttatataatgcggttggtatatggtaggcccttactaagttgtcctttccttttctccttagctaggacaccacatatgtggtgcagatggtaccctgcacactggcacttcgctgaggggtgaatgggtgctgcagtccagtgtgctctcatttttagtaagcctaaagccccagtgtggagctgcattcacactagcctgggttagtggtggccctgcccctagggctctgaggttgagaatcagaagttcatccaggactgaatcctagctggccctaaccagctgcaaggtcctgggtatgccacctcacagcttggtatccatgcctcatctagaggaaatgcattaggatctgtccctaatgctaattcagatgtcatttttttcaaagatgaaatgaaatcatgtttgtgaagaaataattataaaatgaatgtattgtacaatttccattgtaatagtttttatatgcagaataggcaagatcattaaaacatgattattgaccttgagtgttatcgtttagttaggtgggtggttttaaagaaggagccaagagatctttgtgacccttctgagccagagggcagtttggtaatggggaggaggtataagaaatgaggccctggagggagtaagagatacacggaaggccactgtgaaaggcaatgattagagcatgacactgatgttgcttgggccatgaaagaagagaagtgggtactctgctcaattaaaaaaattatcaaaataaattcaatctagaagtagagataatttctcttctaaataagatttgaaatgtgtacatttgtaatagttctatttccaggacataaatattattttaaaatgtgactaaacttgccctgatgccataattttgatttcatagaatgagtacatacttcctcatgcttcatatgcagaatgctttgatttatcagctttggtatattaggacttctggcactctaagttgatgcatatttccattttaatgttaaattactgaattaattattgtatatttctgttgcttcgggtgcctggcagtcatgaaataattcttacaccatattgatgcagacttctggttaataaccataaaactaacatgagcctcccttccttttgcttaaattgagaaagagctatcagagatgctgaagctaaggtccagttaataataacctggaaactatagattaacactgtatctctagcctagaacttctactttatggtcactttaattcatcaataatcatatgcctgtttgctttaaaaaaccatcagtgtcttcatcagcttaggctgctgtaatagactgctgggtgctataccatccagtttatggtattttattatagcagcgtaacttaggtgctataccatccagtttatgttattttattatggcaacctaagctgatgaagacattaatggttttttaaagggaacaagcatatgattattgatgaattaaagagactgtaaagtagtccttggctagagatacagtgttgacagtgctgatatagcaccagtttctgttcttatagcaacagaaattgatttctcacagttatggaggctggaagtccaagatcagagtgccagcatggttgagttctggtgggagcctgcttcctgattcatagacagttaccttttcacatggtggatgggtgatggaactctcaggggtctcttttataagggcaccaatcccatacataagggtagagccatggatgattgggtaggacccaatcacctaccaaaggcccacctcctaataccatcacattggaggttagaattttaacgtattcagtatatagtgtttggttttctagaggtttcctttaaaaatgagcataagttttatgtacaaaatgttgtcaatatttttctagtcagtagtatttattaaccatattaactactgatttaggaagatttcttctttttttccttttaagaatgagaaataaactcgttatccatatatgcgcatgacacttgatatgttgaagctaaaataaagacaataatttcaatgtaagttttaaaatcttctaaccaaagtgaatgtagcaaatgtgtttaatatgatttgaaatttaaatagcagcctccagagttcaggtgtactttattctttcagtaaattgggtggactatggattcatattgagcagttgttctgatttatcttgcctgtgatttcttctccaaagataataatgtaataatgattcattaaggatctcgttacatttaagcattaaaaaaatctgcagttatccatacaaagataagaattttatttttattatttttccttttgttctccagatttaaagtagacatttggtcctgtagatagagtagggaacaagaaaatggtttaattttacatcttaagaaatacttaactttcattccagaagacttaaaggaggtctcagattccccagtagatgcaagaaaatgagtaaacctagaaacttggaaatagatggtgttttaaataattagttagcaaaatgaagtgctcgaagggttttgaggcagcaaaaacaagaggcataactaaattaggtgccattttccagtgaccccatactgatagcactgactgaatgattgagtgcagacttaggaaaatataagagattcgagtaatcagcaggtgacaagtcaaaggagtttcaattgtacaaatgtcaaaactattagaaactttcttttagtacaaacaaataccacagttaaatttctgagagagtaattaatttagtatgtgtttgtttatatccgtgtatgtattatattaaaaagtttatttttaataaattatataaaaaactttatgtgtatacttagaaactacatttattttgttttactacactgctaatcatattacagtatagctttttcataataatgccagataaaaatatctgagaatggattaaattcacattaagaatagttaggagagaaaggagcctaaccacagaaagtcaaattttagtaatctaatttttatgtggatgtttactagagcaaagtgaaattatatatacatatacatataaatatatgcacacatgcctaactgtagatatatatttatgcacatatgtttatatgcatataaatatgtttatgtatatgcatagtctctgttttggagtaaacatacgcattttataaatgcatagcccataccaaaacaaaacaaaacaaaatgccttcacttcaatatgtctacacaattgaagcgatagagcatatagcaaagggagcttgtttttatttaaatgacatctgtattgtttttagtagaactaaatatggaaagccttcccttaattcagttttatctaatgttgtaattggttatctgatttatgggcacatcagttttacttagatacctgccaaaataaaaccaaagtttgctttttagaagatttatacctaaaaaaatcattattcttactacacatgaggctctatgtttgtagttgaaatgcagctattgacatttataactttataactcataaataacttctctgttttaaaatacttttgaaaatctaccgctcaaaaatctgattctgtgaataatagaaaatgcacttaagagaatgaatacaaactacattatttttagtatgtcatcaggttatattgattcttagataagtatagattaaaatcgtaaccacattatccaacattagtggtcactgtttagttgctagaagttctgtcagtagagaaaacaattaagtttgctaatgtagcaagtaggcctgaaatccatgtataccagacaaacaacagctttgtcttgctatgagaaatctgtttgtattgtgagcatcttttcagggaaatcaatactagttttttcttgaatccttgaatgcattgcactattctgtctctaaatggcctcctgtcctatgaaagaaattgaactgagttagggtaaggaattggttagtgtgccagttgtgtctttttgaactcacacacaaacaatttaaaagtctagtttcacaaacagttcttaaattttaagattaaccttaagtatgcaatccttttctgtcttagtttcagaacctgtcacaagggcactgaatttttcccccagtatttgttcttctgttttactgggaggattgttgtctgacttcattgtgtagtttttctgaggcttgcggtacattattggcaaataattataaggtctctatttcttgaccctcacatgtgattcttaaacagatctaaggtatcttatttccacatagatgctgcagatttcctaaaggatcagttagaacttcctggaacacccttggatttgggtcttgcagctggctcttactcaagaaaacctccactaagtcagggcagaatcgctcctgttgctccccacctggagtagaatgaatggagtaacacattttagtttttctctaaaaccaattgagttcttaaagactctgatctctaagtaaaatgagacatttaattatgctagtgaatacaaatgtatcaaattttactttaaaaggcagaggctctctcaaattagattttataaaaattgtttgcagaaggcctgaaacaaagtgacacaataagattaaaatcaaataatgggttaacgtatatcttaattgatatatagtaaatagggaaaattatataacaacttatagaatataagacaaaaaagcattacatgagaaaaaaggactttttaaaataatttaaagaaacatccatggtgaaaacacagttgttgtagtttatgtaccaaacaccaaagcaaagagtgtcaaattaaattgtattgattaaatcgtatattgcagtttggttattaagactggcagaaagagaccaaagcattacttgttataagtttgccataaaatttttcaagggtatttggtgaaacagaagagagtcatctgtatagagaggaaggatgcagcaattgactgtatggcttctcctttggccctcacgctgttgcccttgactctcctggcacaggtatggtctagcgatggtcttcactgagctgaaagggaggccaaatacttgcaaaattggaatccatttacacattggtgtccgtcaccaaacacaccaaacatcaataagcttctcttagaggttttttgtttgtttttaaacaagtgcataattttcaaagctgctttctcatctaggaggaaagagaagttctggggctccccaaacatctttacctccagcactctggagcttaagaaagctatctcttcatatttataaagcaaaacttttggggaaaaacaaaagattagggccaggtgctgtggctcatgcctgtaatcccagcactttggcactttgggaggacgaggcagacagatcgcttgaggccaggaattcaagaccagccaggccaacatggagaaaccccatgtttactaaaattacaaaaattagtccggtgtggtggtgcatgcctatagtcctgcactactggggagaccaaggcacaagaattgcctaaacccaggaggcagcggttgcaatgagctgagatcatgccactgcactccagcctgggtgacagagcaagactctgtctcaaaaaaaaaaaaaaaaaaaaaaggaaaagaaaaaaaagaaaaataaaataaaataaagataaaagattaattgtgttagaaacacaattttattctgggtctttgaccacatagtttgggaagaatttggaagatataattaacatggttgaataaatttctctaactagaaagagcatagtttatattatctgaccaccaagcagtaaagtataaattaatatcaaagctttacgtaagaaaatcacgggagatttaaaagaaaaatcaactttctaaattttgggatcaaaaggaaataaaaactaatcactgacaagaaaatagtggcaatgatgggataaaatatcataatgtatggcataggacaaaactataattaatagacaaattttaggccattttttattaagtaagaaaaagtgagaatagactattcattcagtactcaaatttagataaataatgctgctgaaataatatgaagaaaataaaaataacttaaataataaaatattaattagagacaactttaacagagtagacaaataggttgaagagtatattttaggaaaatacatgctgacaagagagttcttatttcagggtttggcagtatatttaacgttacaaaatattttagcttcttactttttttgttgttgcttgtttcctatttttcgcctcaggtatatggactcttggatagtccatgcatgaaagactttaatgccagttcatctctgaggttaaatacaaatgtgtgtgtgagtaacatttttctaaacgtagtaataatgtttttctaatgtgaatatgagagtctcaaagtagtctggaactccctcataaaaaaatccagttattgtttccactcaaacagtaaatcatcttggtagaccaaaggagaaaacctacgtggtatttttcctttaggaaatatccaaaatatgttctatatctattccatatcttaaaaaaaaagataagacaaaataaaacaagaaacaaaaatagttatagaaagtgctttcttaatagtaacaagtgattcccaagccagattgaaatatcaattatatatgtaatagaaaactactacatttttagtaaaaaataagggaaaagttgccacctccaccatggtattctggaagttctaatgaatgtattgtgtcaggaagaaaacctttgagatataattcttagaaatatgaagggaatattgccattgtttttgcaagattttatttcaaggaacagggtcgttcattaagtattgagtatctgccatatggcagttacttttctaagccctggagatcaaactgtgcacaggacaggcaaggcctgcgcccatggagtgtattatttagagtgactgtgtagagaaagacaataaggaaacaaatgaacaagaaaatttcagatagcagtctaataatttcagatacgatgtcattgtctacctaaaagtcaaaatgtgtttgcagaaaaattattagaaatgacatgaaggaatagtaagctgaggatgtaaaatacatataaaagtaataattttaaagtaattatttggaaacagttatagacaaatatctccattcatgatagcaacaaaaaacataaaatatactgaaacttaaggaagtatagaacatgaaatatatatctgtatatgtgtatgagtgtgtatgtatatgtatataaatgtgcaaatacaaatatacacacacacatattttctttttaatttggaaaatccgtgactaaatggggcaacttaaatttctgggtagaaagatgcattgtggtaaagatgtcatgtcttttcatacttttaaaataaatgtactgttataaattaattctaacaagtttttaaggaaacttgtaaagagaaaatgacattcatctgaaatgaacattaaagaaccaccatacataatttgattaagaagagaaataaagtcacccagcctacaagatattaaaatgcatatcataaagctgcaatagaaatgaactagaaaacccagaaatcgatgtgctcgtgcagggatggcacatttgtggcacagttaccttctttccccatattgttaccatggtagacattcactagtaattgatgttgtcacatttccctgctgggcctggacgtgatctcagaactagatgaacactattaggctatcaaagttggcacgtggattaaaacattttggcaccctgttcaggtatatgataaaactggcatttaagttagtaaagaaatgaagggttatttcagaaatgattctgggaaaaactggctctttggagaaaaaaatagtcctttacttcacattatatactgaaataaattccagatggatcacaggattgaatgtaaaaaaagaaagcaggaaaaagcttgaagataatatagatatgcatctaacattaaagaaagcttttttagcatgaaagaaaaggaagaaatcaatacaagaaagaactgatgaccccgtctctactaaaaaaaaaaaaatacaaaaaattagccggcgtggtggcgggcgtctgcagtcccagctacacggaaggctgaggcaggagaatggcgtgaacccgggaggcggagcttgcagtgagccgagattgcaccactgcactccagcctgggtgacagagcgagactctgactccgtctcaaaaaaaaaaaaaaagaaagaactgatgaaattactacaacattttaaatttctttgtcttaaatgtactagttacaaaacatactgggtatgttttacaatgttttgtaaaatattatttggaagtacacataggccaggcatggtggctcatgcctgtaatcccagccatttgggaggccaaggtgggaggatcacttgaccttaacagttaaagatgaatctaggcaacataggaagatctcatctctacaaagaataaaatagttttccaggtgtggtggtgtgtgcctgtggtcccaggtacttgggaggctgaggtgggaggattgcttgaacccaggaggagaatgtggtgacccgtcactgtgccgctgcacttcaacctgagggacagagggagatcctatctcaagaaaaaaaaaatgcgtacactcaaaacatatacatatgtactagaaggattaaattgaataatgctaaaatatttatagtcattttttaaagattgagatattacaggttattttattgtattttttactttctatattatttaattctgaaagggagtgcctgtcaaaattatgaagggaaacattggaaactaatatttttcaatatcaaatattcaatattttttccttagcttatttttgaattcccttaacagcttattgaaatacataatggcgttctgcttttaaacatcagtaagttgagattcagggagagcaagtaaatactccaaaatcactgatgcagaaagcagcagggttgtgactggaaaccagtagttgagttatcccataagccattagccagcatgttatggatctctgccctgcttgatgtcaggattggggagaaaaaagaaaaaaaaaaaaaggttaagttcaagtccaggcctgatctttcatcagcagaagggggtttattttattctactttctgtgtctgctcctcattccatcccagtagctcctattcagtccttcaaggaggtgattagatagacacatttctcctgtgaaggatgttaggcttttgagacaaaacatcacagttggatgtaaagtgagacctttctgtttctatttaccttttgcaaatgtgagactctgcctgagataatccttcaatccttcttttcctggcccaccaatgtgtaaagcttggattcaagttggtgtggatgccaaaagtgttaactttgaaaaagaaaagatttatttccttattatagacattcgagaacccttaattctatgtgtgataggcaccttactgcaaaaagaggcaaagtgatggaatcaaataaacacattacagctccagataagaaataagcacttctcaaatgcaggaatgttttaagactgttaatgatactagataggtgtatgttcaataacgttcttctcacagtatgtgtgcttctaaaatcatatcattttcctttgggataataacaccataagaaatgaataaagttgccttagtatgctagtgaatgtagccagttttcaattttggtctgggatatgttaacccactaaagtaaatctgagtgtattttggaaagatacatcactatatcactatagatacattgtattgttttctggtctgtggtagggtctttcccttcctcttctgttgacaggagagtattatttgagaacatctaatcagatataacaattttcaaattgactaaaataagggccatagtcatacttacgatattgttcttctggaactattcgctaatagccatttctcataaattggctttagaatatacctctaaacaacatgatagtgaccactttattgcaaaacaaacccaatgcactgaatctttttatttttaaatacattttataatattgaggtcattacaggcattctctaagagctggaagaaaaaatttcctagcataggacctgctcagtatgttatagagtggacgatatttaatttcactgagctcctttccttcttcccagtttgcttgtcaaaaaaaaaactcacattccatatacccaaaactacctttcaagctgcttttaatgtttaacgcactctttgtttctgcaaagatttagcatttagtatttagatgattatacttattcattttctatttcttctgatcattgtgcttttgatttcctgatatatctgtctaccccatttctctctggtgaaagccattcaggctcagcttaactcatcaatgaagctctccccgatccccaactctgaactcccatagattgcttgtttgcacctctgacaccatgtaccttgtatagatcttttcataagttaactttctggcagccccataatgtgcaccctgggcacctgcatcatatatgtgcagttttctcacttctttatggttttcatttccttgagtaattccttactcctcacctcacttggtttgtattttctatcaactccagttttagacctttaaatgaggtcttattttcattgaacttgcatagaaaatcttattttgtaatgttattttgcaatggcctctctaagacaagccttgtggcccccctatgcatgttacttaataccttttgaagccaaaacaacctgaggccacaccctaacttgaaacccaggtcacgctcgccttgaaccttcccacttaccagtggaggggaattaaacacttacaagaacatcgcatgtaacattacactctatgaggtggtcccccagtcccttttgtgcagcctagttagagtaatcaaagcaactcatcacgattaaaccatagctggaaaagagactgttctattgctatagtttcaagcaatctattcccactcgtattcagtcctcagagaaaagaagattacacactgccttcttttgtcatttcagctcttttactgaattccactaatggaatttagtctggtctcttgggatacaccacatggccaaattcattctctgcttttgacagaaatatctaccatggattctctcccttcagctctctcttaccattttcttcacctcccgcaatgtggcagctcatcagtgtttttatgtctttgtaaccctcttgggtctggcctttcatgaagattgccagtctcagatctgcctagttctgctgatagataaggaatatggagcttccatttctgaggataaaagaagattcgaagaggaagagtatctcctgctcaaagagggcttgtctctctttgctttaaaaagctcccatttttataagttgaatcttttctatgtttcagcatgggctggatcaaggggggaatctaccctgccacagctttctgtccatcactattcttgttctatttatgtgtagattttcagccaatataatatgttggtacccagtgaggagttttgcatataaaaagggctcaattaaatgctggattcataatcctgcccatttaaaaaaagtcccacattttattctcttttgctattatagaatctgagtacaattaaagctttctccaaattgcctgtgttgtatttctcagtcagaagcttgcaaagaatattttaaacagttgtcgtgtgggcttttcccgaaatgccatgtcactccaaaagtgatactctgctattttgactactcatagaaaatgaggaaggaggtaggctgaacagagagaaattccaactgaagtagtactcctagccaagccagtggtatagcaccattgctcatctttagaattttagaaataactaaggcagtatgtacttttaaaaaccttttatttcagtggcaaaataaatgattaaataataatatcagttggtatagggataagcgaataaaacatctcatttcttgatattttttatatgaattccaatagtgtgatgtggttatagtctttgttggggactgtgtttgtgacagtaaagcaataaattttattatgtcattatgtgaaaaacatcttaacattttttgtgtgtcttaaagtaggttacagaggacaaaataatctgtggagagaaaaaaaaaagaaaaaagctttccattcacgttagattgcagtaacccagtgatttcttgtactttaaataatttctgaaattttagttttaaattctagtaagaatatttttaaattatacataggatctatgtgggcccatcttatccaggagagagtttatttcacatattcatgtaggcttgttttacaaaaacgacgtaaatgttatgactaaaaaacaccctgctatatttgtacgtgtggctaagataatcaaataagaccattcccaagttgtccctagagtattttatttatgttcccagtacccctgccatgactccctgagaggttctcccttgacactgatcctccttgagcacatctgaagtagctggtagggaaggtgtccacagtgagggctgtgtagctttcagagcccccatcccttccatgtaagtctgaagccccaatattgttttgtgcagcctgtgaggatagaggagaagggaaggaggaagtatttttgagaactagtttcacagtgcttttttgaaattttaatcagagagtttgcttttttaaaccatagacttgtagtttcttagtactttagttccctcagaaatttaacaggttctgatatattgcttctagtcagttccgtgaccaggaaacacatgaaaagttgttctaaatgtagttcctaactctgctctttttctttctttccatgccccgtgcttctttctctactcagtggtggccaccttgagtccatctgaaacaacagactgggggaattggtggggtggctttattcttagctacaatactatttttgttacagaactaagtcttttgtgaattgggaattttaatggaattttgtttttcaaagcttttatatttatttttgctctttgggaatcagatgcagtgtaatttttcagctcttcaaagtatcaaatttcttgacactctcattccttttcatttctagttaatttttgtctgaactaacctttttcttgtcgtaccttgcagtcagtggcaaaaatcaacaatatataagaacatcatggcctcttgaaccctcttgttcgctgaagctgcagtttcactaggcaattggattgcctttcgaatagctgtaggctttagttttactgaatgttttttcattggtatgagttgccagtattccagcttgttttgtctgtttttttgctacctgattttggccactaagctaatacttaagtgttgagcctttgttacagtcccaattcatttcaagttgtcaattcactttctctgttaagctaggctaggagtagtagcacagagaccacaaaataatcagtggataatcacaataatattttatttctcattcacgtaagagtcctggagttataggcatttaggacagcacagcagctctcctgtattcttcagggccctgtagtgatggtagcttcgaaatcagcacatggcttccagtgttgctcaggatgtctgcatcccaggcactagaagggaaacagcatctggacgagtgctcatggtcattctgtaaaggctagatctgaaatggcacttgttacttctactcacattctgttggagacaaggttgtcactttacctaactgcaagggaggctgggttgtatatggtaggaggagagaaacattagtggctggcttgtggtctctgccacaagatgatgggaaggaatttatgtatgtcaagtatatgcataagcaaaaagaaaatgtttaccttaaagacagttggacttaatgattagatgataagggaccaaaatatggaaaaggaactgtgaactaatcattaatatcatgtgatactctgaaagagataactattttgattttctaaaaatgcagcaaaggcaaagaggggttaataaaagttggcttctgggattgtatactttagagagtgtgtgacttcctgaggatacagttttatatttattttggcattttgtgaacatgactaacatgttctccatacgcatcaattagtgtagttgttctgaaaaaataagatatttttagatctcagttgtgtttgaccctagagaaagacaacacacacacacacacacacacacacacacacacacacacacacacacgtcgtagagaagggaagtaatgggggatgaggcaaggggtgagaactgaacatttatttgttcaaaggtttgaccgtgattttcttggcttttgttaggaagaatatagctagatttaaaagtaattctcggataatgactagacacaattcagtagtgtttgcatggctcttggcaactgatcactccctggaatacactgagagagctggagagggggtttcagtgcctgctcttaggtttttcagaattatggctgagatcccagtaggtcagcaaggtctgtctctcacagcaaccattggttcctagaaacccttagggtttacttatgttcttgaatgtttggttttattcttagttcctgtttttccttcctgtcacatcctagaccaggccactttgcatgtcattcttgagttctgtagtagtttggtacaggctactcctctctttccacttcagtatattctgtgtccggctttttcctgctcataaaaccttaaattactgtacgttgttcaaaggatatatttcagtctgtgcctagacaaagcctagtccagcagccagaagtcttcagttctggccccagttttgccactaactagctgcatggccaaggagaagtgacttatgagaatatatctgtccccagcttctctgtgaaacaataagcattctaaggaagattagaaaacattgtgtttgggctgggcatggtggctcacgcctgtaatcccaacagtttgggaggccaaggcaggcagatcacttgaggtgagtagttcaagaccatcctggctaacatgatgagatcctgtctctactaaaaatacaaaaattagccaggcatggtggcacacacctgtagtcccagctactagggagactgaggtgggagagttgcttgaacccgggaagtggaagttgcaatgagccaagattgtgccattgcactccagcctgggcaatagagtgagactccatctcaaagaacaaagttcagccaggcgcggtggctcatgcctgtaatcctagcactttgggaggctgaggtgagcagatcacctgaggtcaggagttcgggaccagcctggccaacatggtgaaaccccgtctctactaaaaatacaaaaattatccgggcatggtggcacgtgcctgtaattccagctatgtgggaggctgaggcaggagaatcactggaacccggaaggcagaggctgcagtgagccgctatcgtgccactgcattccagcctgagcgatggagcgagacgccatcccccccccaaaaaaaaaagaaagtaaaaaagaagagagaacattgtgtcctacatccttttcttggccatctgaagttgtatagtgatatattttagatgtttcgggaaatcctgtcacaaagtgacctgtttacctgcattaaaccttgcatagccttcaccaattggccagcaaaaccttttgttcacataacatattaacattccacctccacacaaatagtgttacccagaagacacacttagaaataatgaactatgttgaggatactagagagcttctgaaaatgtctccactttttcatctttatcacctattaagaatggcagctttgaagtaagatgcctggatataaacccctcacttagtacacagacaattttgggcaagttacttaatctttttgctctctggtttcttcttctgtcaaatgagggcaatagaagtttttaccatggggttatttacaggattccatgagttcacacaggcctagtgctcacagcagagcctggtatgtagtaagcattgcccattatcaataggcactttgcctatctcctccatggtgcctttcactttcccacactttacttttacttgtatctttcccttatgtaaaatgacctcctcatcctcataatttaactagcaatttctttaatgaggtgagcaagacacagtgaaaagagagaagttttgagtcacacagatttgtattctcattctagaatgaccatttacaagttgtattacctgagtgagttactcagcctatcttgaccttagattccctggcaatctgggattattataatatgatccacaagtgtgctgtgaaccttcaggtacatgattatacattctctttctatctctgtctctgtcactctctctctctctctgtctctctctctctctctctctctctcacacacacacacacacacacacacacacacacacactgtctatatctaatctctgtctctctagatagatggatagatagatggatagatagatagatagatagatagatagatagatagatagacagatattcttaatgggtgatgctaatgatgttaaaatccgttactggtaaatataggtatttggtaaatgcaaacgtgatattcttataattattataattattagcttaaatcctgttctcactctggcaccttttctgacatctgcaatccaactaatgcaattttccagagaatggtaagagattgacctctgtgtattgcgcatccagatcaatttattattgatattgttagtattttaccttgtcatcaacaaagtatttgagttatacttttatttttccagaggacatgatatttcattcttcacatgggaggggtcactcagatatgatttagactagaaagaaccagcgagggctaagggaagcagctgaatatacttttcctctcaccctgtttatttgctggacttgacattcagagttaacagttcactaaaaaggtgtgaatgtaggtctggccatgactggcaaaaaaaaaaaaaaaaaaaaaaaaggaaatactaataaaatagacaaaatttcaccaagatttttaaagaaaataattaagtgtggagggatgtatgaacattattagaaatgggaatgggcagaacagtgattcacttgtgatattaaaatcttaagtaaatacaaaaaaattgctgatgattttaaaaatttagataaaatggattttttttttttaaaaaaacataaattggctcaagatgaaatagaaaatctgaggaacaataatcactaaagaaattaatttaggctaagaagaagagtgaattaaaccagtaaagtttataagaagtatcctggacaagagaagaaacataaaattggtcaaaattagaattaggaaaaatgtattttggaggagagataatcttgaccagataggatcagggaggttcttttcaagatggattagacctggatagtaaaggagtagagggaacagaggagatttgcagcaaatgcagcaaaatggtcacctgttttaaatcaggcatgcttctcctactatttttgttacttttctagatatttgaaatatttctaggtttaaaattaagtttttaaaaggatggatgaggtgaggcagggagggggaggcatgtagaactgtgaacagaaagactcatctggagtcgatttttgtttagaagtgcaggaggaaagtgagctaaaattaaagccacagaattttagagtattatgggaacctcccatttcccattcctgctaccctgacagagctgcttttaataccctagatgctgaaagcttaggaagctttttgattttttgtgttttgtgttttgttttatttgttttgagtgaaatcattttggccttccttttcttggttatgggaaattgtttcagtgaaaatttcctacaggctgcttaaaagccacgcacggaacaatgggccttgtggcaagtgaattgcgtgtggggaagtacttagagtttaatgtgagttatttttatttccattcatagacatgtctcagtgaagttcaaattatcccttggacaatagaaggcagtctgttaatttaaagctagacttttttggttccataaagccaaatttaggattgatttcaaaagctaaataaacaacagtctacctccctattaaaagtgagtgtgtcaggtttctgtgtaccttagtctttaaataatgtccacttagcatttctacaaggggccttaaatatttagaaagaggctatcctttacaattataccttgtttgttaaagggacactcaaaggttggggctgtcttaatcttattactaaaattctgtaggtgtcacatttattttaacaaattaaaatagaggctggaaaagttagggttattgcaggtggtgtgattggaaatattaagagggagcatcgtctagaatccttagagatattgctcagcatcattttcctacaatgccataaaatattattcttaaaaattgtcagaggaaacaaatgttacacttcctaggagtgcttctgaattttgactcttaaacagaatcccctgtggagttcttaaaaagtacacatattgggaccctgttttggaaattctgattcagtggtccaaggggactgggcctgggtgtgtatgcatgtgtgttatgtgtggttttgtgtgtgtgtgtatctgtgtgtggaaagtttcacaagttattttaaagtatatcttgaggatcaagggctagtacaatagactacatttcatttctgttgaaattcattatttaagaactgtactctggagatttaccatgtcaggctgtaacaaggctattgctttcaagatggcaaggtaaagtcttagccgaactgttgtatggaggagcgtgtcatttctgataccaaaggacactatgcaggccaatcagcaacacaattacctatgtatttattaaatagtttcatattttagtttgaaatttttcatttaacataatttaacaaaataagacaaaacttccactgagttaaatacacaagtattcagacatttaatagtattctgactcaatatgatggtcaatgtgatttaccaaaaaatttcagtaaaaatgataatatcgtaattttacaaggtggatttaaattgatacttgcactgtttgactttctaccaaaataggagtacctggtaaaatgctgtggtgtatggagacagttatgagaaactggagggaggatgatagttgaggtaagttcaggctttgagtcacggttcttccaccagctgtgtgacctggcaaatagtttaaccttaaaatagggctaatttttagcaacttcacacattatctcacttaatactcaacttgactaggtaattttgagtatttaatgagataatgtgtgaaaatgcaacataaaaattaaagcagtataattaattgtttggagtggactccctttgcacttcttctctattggaattaatgcatgtatgggactatcatgtggtaattttgtgcatatagattgtggaattgcagaataaatgaattatggcagacattttcacatttatatttttagtgacctaaggcttcaaaaaaaaaaaaaaaaactagatacctccccactcttatgggaaggagagaattctttgttagagtattctcaagtttgattattttttcctgagattggatttctttgatattatttatgatcacaacaaagatacattttatgtatcggaaacttgacattgccaagacatattagactttttaaacatgttacctttttaaacactcaaccactgttctcccaaggccgttaccttatttcagagaaagcctaaagcctttaattttacctcaaaaagttttgatctgtagaatttcatgttgataccattaacatttgatgccatttttctatgtgagaaaaatttaggaggtagctaccttcttttgaaagcctatatattggcctagtagttgattctgttttaaattatgttttgataaattataatattttgaaattacactttttattctattaggaaggatgtagggacaagccagtctttttatatggtttctagctgagtagattgtcctgccaatgactctcaaagtgtcattcccttcccttcccttcccttcccttcccttcccttcccttcccttcccttgccttcccttccttctttccttgtttccttctttcctttcttctacaaatatttaccgagggacattgtgtgccaggtactataataggcactggcactgggagtagatgtgaataagaaacacaaactccccactcatacagaatttacattttagtgaggaatatggacaataaataggctaaaaaacttataagatgattacagaaatgaaaagaactacgcaggtattggcaggatgctgtagaagggtggagggatagtatagatgagctcatctgattgcattcagcacaggatatatagttagtttattaatattcccaatagcttggaagcaaagaggagttgatattcccccctccccaccttctccgtatattctcctctctaacttgattttccattttaggctgctcttgattttttacttgaattagattctatcctggaaattgttttaagggatagaggtcaaggtgttaatttttacccttgattgtcactgttaagagacaatgcccctaagtttcacactcctttacgcagaccaggcttaaaaattccaggtttctaatcagcggtgataattgtgtttagccaatatattaaagactgctaaatatttggaattttacatgggaaaaatacttcagttagcatgtttatcccacaagttctcctgattccttgttgccgattttgatgggtgaatttacttgggtcaaaggttgtcattgtgttgtaaaacacatttttgttttttttggtttacttgtttgtttgttcatttctttttgacttacaatgtaataccttctctcccaataccgattgctccccacccttgccccagaattcagtcttctgagtgagagaaatccactctatgttggaaaaaaaaagatcatcgtcgactcctatctttaggcagatacaaaagggtattgagagaatagatttagggtgcatgagaataggtgattaagggatataatggatgtgaatggaaatagaaggcacacagcttttaaatgggtgaagatgtgtggacgagagaatacgggggcagaagggagtggtccttgtatattagtggtcatatagtttttgtttttcaaagaaaggaaattgacattgacatattagcactaagttacctaagaactttgttggtaaaaatccactgtattttcaactcagaatgcactgagaggcatcaaatgcttttttattacagaaagaaaaacatgtcacaaaatcttgaaggggcaatctgaaatcaaagctcttcattaaggcaaatcagcatagggattattccctaggcaaatttttgggagatggatcgtacactttattcactgttttaggaaaatgtaatcacccctacctcctgagaaaacatttagcttcccatcctcccagtgttagtgggtgtctttgagaatgcaaaattcttttaatgttaactaaaccagacatcattcagaaatgcaatctgctttttaaaattcatgtaatatatggaaaaattaaaatataagtgatttttaaacattctgccatatggaaatacattctctatgacatcccttctccattgcctgataacaaaaagccagttgtagtgaaatttacatcagagtttgaaagacagaaattccacattcctgagtgttattgaccctattggtagtattaaatcagtcaggagggccagagaaggggctggcctgtggtgtcattttaacaatgtcacaaagtagcagcctcccaaaccaggtattgtctgtgtatttcatcctaagaagcgggagctggcaagatcctgaccctcattgattcagccacatcatcttacagatgagggatctgaaacccactgaggttcggagatttgtccaaggtttaaatacccaacctgaaattccaagtttattctaaagtaaatttgtattacagggtgttatgatccatttctaaacccgaatcctagaagtcatcccttgtagcttctacttatgagtattttccacaactgcttcaaagggctgtccttcttcaactaacagtatttcaaaataagcaaaaactatttaaagcacaactcagaaaaacatagactagcatgatttaataatgaacaatatcagtttttcaattgattccatatttttctcagattttaactgatgtctttgtattttccatgtagaaaagaaggtatgcttaatgtgaacattgtgaaacaaaataagattttgttcttgggaaacccttttacttcaaatttcagaaagtaaagcactgccttagagttgagtttgtttatttttgttttgtttttgtttctttttgtcttttatagcttacaacatttgcctttttttttaacctggaaacattgtgatggactttatagttccttagattggacaagtggaaagatacaggattgtgcgtatgagcctttgctcaacccagtgcttgagctgtgttagcccattgaattctttaagatatatttcagtcataattttacatttaaatatggttaaactaagtttagccaattctgatgcatttttaaaaagaatgtgctgttgagctaagactctatatgctgtattttagccccaagcagatttttatgacaaagtaataaacccctggaaacatgtttataatggaaaatgcaacttgaccttaactagaggaacccaaatgcaccttacaaaaaggctcattttttttttgaaacatacgaaatccctttctcccagaggtggtgtcacaggagaaaggtgtataataatagttgtatttaccataaatacctaacatattttatgatgatttgattgtattaaaaaatttcaccttatagattttaataaagctgcctatgggcaaagttattgcagttggatttcttttcctttgcccactgctctgtgtggaaagaagcaagcaacccttataaaaggctttagtttttagtacctggttaataaaaaataatttcctctcctttggacttgttcatgaagctgaaaaatgactctgcaggtcagtggtgtgtggcaaagctaatttctataagctttttatcaggtggtactgagtaaaacaatatgggaaactgaaaaacccacccttctgtaccagatttacaagggtgagggttatccccagtgtcacaaaaagaaaaaaaatgacactttttcttcccaatttctggtacagtaacgaaaaattctgtgttataaaaggtacgaaaggaagaactaaattgtatggaggtgttcagctaaatttagattttaaaattcggacacaaatggcactcattgtttaaagcacagtaaaactcaactttcatttgttgttttgtcgacaagggaatctcatagtaataggctaaatgaggcaaggcacatcatagcaaccaggaaagtgattgtcattcaaataaatatgcaaggcttcttttccccaagcatcacattttctcagaggagtactaggaagacattctaatcaagagaactggagctgcttcccttgaggttcagcagagtgtttggtgtgtgctttgcagagcatgatagagaaatatcacatccctcctgtctctccaagatattcacaggccacattccaggaaagaagctggagcagggctgcataaggctcccaggcacctgtgtagctggcaaatctgctcccagcaagcttgaagtcacattcttttctttagtttttcaggctggggaacagcgaggatgcacagcagcaatgtatgcttaggaggtcacagaacccttctttactgtccttgtgtcagggtacctagggccttcttacactggcctattcgcatcagagcccaaaggaaaagtcagaaaccacaggaatttggagaggttatgggtgagtctttcttttatgatttctattttagcagctagcatggagacttgtagctgacaacattagatggaagaagtaccatgctactttggagtcatgtcttagatgaaggtaaagagagaaaaataattataaggactttggaagatacagactgttttcccttatttagtttagtttaataaaggtaaaagcatgcgatgtgtaggtgtgagagaggttttggattgtaagggtagaaatacgtaaaatttccaacataactgctgttcaacagctgtatcaatgatttggagagtgattgacagggaagaggacatgttttactacaatactgaagtggaagacagagatcaagatgggtgtggtctcagacaagcatgttgctgtagaaactgggggttggcagtattccctcccaccagatgacttcttggtttcactgtgaagttggacatggggtcatccattgagaggatagccgggaggtatgaatgggaacttgaaaagactggatgaggaaggtggacagtttctggaatgggagcagatgctgaaaagtggcacttagaaaagttgagaaccctgcatcaatttatacatgcaattatgtgagtcaaatagaggaggatgaagatgaattaggactctactggataggagaggcagaggaacaagaaagtagatgtacgatgaaagccatgaatcctgaggcccagaaaaggaggaacagactacagtgacattccccttcaaaaactggagattgaatcctgcaaaccacgtctgcattttgtgaaacttactttcctcttaggttttctttaatggattgaggcctgagtgtttagattgagctatcagaagctaaataaacagtagtgtaatttgcataagctagtctcagatgccttagttgtggtataaaaacgcttgggaaactcatctaaatttaatcttttgtaggctgtttatgggctttctggagaaaataagtcttcctactttttgttcagctttcattacttttaatcattttggtcatggcatgtcaaaggttttctctttgaaaagtgcttttagttggtatttttaatgaagtgttatccacttaaagtgtgatataattgtgatattacagctagcagggaacaaaacagcttgatagtcacttccagggctccttgagaaaaacttatactcaaggaaaggtcagctcctctctactctgtatacatcttttgggctcacttttgcacagctgctttgcatgattctatggctgtttgcctcatttgaagatgcagttgggaagaggagcaaagagtggctatgctggtggttggggtggccatattctgcaaaacaccgcattcttctgggagctttgcactttgcatgataagacttaatctgtccctttcaatcataaagtggcagagctagggtatactgtggtgatcatcatggtggtgatcatggtattcatgatggagaataacctcaatgcctcagcagaactggataggtaattttctcttgttataattgtgctcaacaacctgcattggtttttgcctcagttacatcatgtatagagtaaacttaaatgcatgagctttcaaaaaaacccatgctctagtcctagcctcgtttttatttttcttccatattctgctacgtacagctctcttggccagagttactactcatagttcacaatctggtgttacctgcctctggtatttttttatacaggcagtttctctggccctctttccattttcttctatcaaaattatactcattctgagaaacacaattcgaatataacttttgttgatattctcaatctgttgttccctttttcagctcccactggcctttatttgcacactgctttgtggcacttctcatatccacttcctgatttatgactgtttttatacttgtttcattcttttctcaataatctattttgtaaatgccttcagtacctttttgagaaaggaaacaactaatatttgttaggcactgatcttgagttaaacaccatggttgacttggagggggtggatacaatgaaaaataagacttatatccctgttcttcagttctcaaggatcttgtagtctaaccagaagtaggacgggttaacagatatatcaatataatataataggcataaaaatacagtaagctcaaattgttctggaaaacagagtaagctgtctatcctgggatggagagctcaacaaaggcctcctaaaggaatgaaatgaagtaaatcttaaagactgagtaggaatctttaagccagaaaaggaggaggttctgatctgaggaaagagcctgtgcaaaggcatgagacagtgtgggggatagagaagccattaacttctcactatcaatgtagtataaagtaaaagactgagtgaggtgggtggtgagctgggagtgtaaaacagggaccagttcatggagggttttgattgccaagctaaggagctggacttttatcatgaatgtatcggagtgccctcagaaggtttcaggcaagtgagaggcatgataagatttctgggttggagaactcactctggtagcagtgtgaataatgaacatagaggtgagagactggttcatatgtggtattgctgatggttgggatgaattttgtatgtaaaacagttgaatgaaaggttgctttcaggcacttctttactggctaggcacctcttttaagaacagactcaataaaaagccatatacattatattacccttcagagaaaattttgggtggcatagcaaatctaaaaaaaatccacaggaaatctgatgttctaaacagagcgattatataaaacgctggctgtggcttaagcaaacgcaatcacagaattgcctagctgtgagtcagagtcggcttgatcctgaaaagtcccttgcttgatagtaaattagtggcttagggaaatatgtttacatttcatttcatattgtacatctgattgcatgttttgagaattggatataaaatatctttatttacagatttggagctgggaattatattgactgtgtgtacatacagacttaaatttcccagttaagtgtataaatacagtgaggtatatacttacatagcaagataatgctaatttgccattttatctcaaatagaaacatatccaagatataataatggaattcagtgactcttacggtaaagtcatcattactatagaatggcatactaggtcttatgatttgatcaatactaatttattgggggaaggcagaacaggtttaactatttttaactatttctttccatgtacttccatatttctttctatcataaaatcgaaacacgctgttgcacttgttattttcctgggtcttttttctatattcaaaaatacacctgctgtgtatttggttgtagcatcagagtctagcacagtgcctagtcctagtaatttctccatgtatatttgtgagaatgaaatggcaaaatgaataatgagtaaatgaaaataaataaatgcataaacaaatacgtaaatgaaccctaggtaggcttggctcactcataaacatttattgagtagctactatgtccaaggttctgatctggtacaccatggtgagcaaggcaaaaacagttcttgccttttgagttcttgctttatagatcaagacatatgttaatcaaatagttatagaagaaaatatgtaattaagacatattgtaaacattgggaaagaaaagtagaacttgctatgagtctatttaatggagagacttaatctaccctgggtagggcagggtaaataagcttctgtgaagcagtagtctgcaagctcagacctgaatgagttagcattagttccatgaagaggggcgagaccttgtaggcagcagaagagtcttttagagctctcgaggaggctaggaatgcggcatgttggagaaactgacaggccaatgcagaaaagaaaaggggagttgaccttaatcagaaatcaataaggatgaggcaatacgtatcttcaaatttcttctttgaccacatgtacttgtcatataaaaatacaaatataatgtcgtgtaatgcaatgatgttatattcatatttaatatctagttagtccaccaaaaggtatctattgattgacaagttgaaagccagcaaaaatgtaagaggcatcctgtctttaagaggtatataacatacataggcaggacaaatgtaatgttttttttaaagggaaaaataataaatcatgtaaacgatttatcctgaatgaaagagcaatgtcacattagaagaaggagaatgagaataggttgtatattggagaattatgctaggattacgctagactgtaagttctacagggtaagggctgtgtctaacttgtttccagtgcttagtgcctaggcaggtatataatataattactaatgttgaattgattttacttcactttgtattcttgaaattagggtttcttatactattaatagttaagcttagaaacacaaaatacagtaaatcttcacttaatcattgataggtcttggaaactgcaactttaagagaaacgttgtataacaaaatcagttttaccataggctaattgatataaacaatagttaagtttctacagtatatttatggtcacaaaaatcaccaaacttctaaatacttctaatattaactattgaaataaatgtaagctatatgtagaaatgtataaaaagaaagattaataaaaagaagtacgattattgtttatctgattattctacttcagggttgtgggtgtccagagctcaccccagcagctcagggaaccagccctgggcaggacgccatcccattgcagggtgcactcacacacaccctcgcacttacttagatggggactatgtggacacaccaattcaccgaacatgtgcaactttgggctgtgggagcaaacaggaggacccagagaaagcccgcgcagataaagggagcatgcgcaaactccatatagatagtggcccccggcagggaattgatttttttcttcatcaaagttataacaaaataacattatttgaggacatgctgtacatagacagcttcatttggaaatgaaaacctagtaaactttccctagctctcccttaaaacagagctgcttcagactagttttacattcctgtttttacctaaacatgcacaaatataactccaatttctaagtattttttgccatatttaattctgcttattgattcctgttctagattgcttttcagtgtctctccacacattttctccccataatcatccccctatcttactcacttttccttccccaagtgaaaatacagcacagccagtatagaagcatctgtaacccacagtgaagtgggaatagccattttggttcctttcctcctggtattgagcaacttttgttcatcaaatctgaaaaacaatatccagcttacctgggcatccttcttagaaaggtaatggagattggggcataagaagaaagaaaatatcttttgaatgtgcaggattttcaagagagaaaaaaaaaatatgctagggaaagaaattaaggcagaactgatagtgttagaaaaggtacacttgaattttttgttttaaaatagttcaagttcagataataatttgccatcttcaactttagcacttgaactaaaataccgctttagcactttaacctgtagcataaaaacaatttaacaaaacaactttggcagattctgcttagttgcctgtggtttctagctgggtttcctgcaattgcctggcagttcctctctgttctgaccagatttctgggtaactggcctcccttcccctctgggattcatgaatcctgtctaccaggagttatcacacaaacagttagttttagaccaatcattggttgtaaatatatgttttaaatataaaagcaatattgtacaattatgttacctacagtttttagaataatgaaaacattcttaaaaatactgataattcagctagtataacatgaacaagtgtatcattttggtttataaattatttaatcgattcaaaataatatgacttttccataattgtaagtagagttaacacaaaacattgtcctactttctcatccaaacatttttataagacaagtattaggttggtgtaaaagtaattgcagttttttgcaattacttttaatggcaaaaactgaaattatgtttgtaccaacccaatcaatatttccctttttttctttttctttctttttttttatttttttcttttgagatggagtctcgctctgtcgcccgggctggagtgcaagtggtgcgatctcagctcactgcaagctccgcctcccgggtttacgccattttcctgcctcagcctcccgagtagctgggactacaggtgcctgccaccatgcccggctaattttttgtatttttagtagagacggggtttcaccgtgttaggatggtctcaatctcctgacctcgtgatccacccgccttggccttccaaagtgctgggattacaggtgtgagctgccatgcccggccttcccctttttttctaaaatacttttacgtataacttttttggatgcctaattttggtctagtaactacaccatattgtatgaaacatctctcttatgattagagttttaggttctttcatctttgttttttttctctctttttctagttattaaaaataatatagtgatgaaggactctctttatacacataaagatgtattgcttaaaattacttatgtgagataggttcccagaaataatcagatatatcttcttagataaaataaacaacttggttacatgcctggaaaataataatagaaatatataaacaatatgtctataagcaattaaaggtgtatcaatatgtatagacccagcttaggtattctttcttactgaaatctcctgatctcactatatgtatttctttctttctaaacttccgaagtctaaggtctggtccttttttctttcactccagatcttatttatctctcagtctgttggagaggattccactttcctaatcttcatgttttgttcacctatttattgagttctttgctctatatctagaaaaactcctgaatgctatccgatgattcctttcttggacccaagagtcatttgttcaaaatgttatttgaacatctctgcagtaagtatagttgttcatcagggacaaataatgttgcacattaaaatcttgtctccttatgtattgtgttctaatgtctcaagctactgtaacaaatctcaaagtggggtgacacgtttaggcaaacaaagagcctaaaaacgtatgaacagccaatagaaacaggaaattcaaagtcaatgtgcagccttctgtgattcatcagttcaccaggtaagatcttggataaaaaaaaaaatcatcccattgttcacacagtctctagcagaatgtgggtaggcacttaataacattacaatgcagtttgaattcttgaaaccctgcaaagcatttatgagttaaatgttagagcactaggatgcaccattcgatagaacaatagtaaaactggcagaactgtttttcatatgtcaattaagactgcactccggagaccattaaggaaaaggatgctgctattccccgcagttaaaggaaatctattgtgtttcctttggtctagatatataagttctgcagaaaatgtctttcagtaggttaggatctgctaagatttgatcctaaattatttttcagatagagataataaaatcataagaagaaacactttggattctaatggagtgagtttgagttctggccatattcaattgtgtgtcgatggacaaattaacctcatacttacatcgtacttacgtcgtggaattattgaggggattaaatgagatgatgtatgtataatgcttagcattatacttggcgcaaagttggtactcaataagtgttaatacttattagtatgatgattttgttaatttgatgacaaaaggggatgaattgtgttaaaatcagcaaatattgaagaaccaacctaaaggtttttcctcactagattatcagctacatgaaggcaagtatgtgttgtcttttaaaaaattattgtttctacaatacataattcttgagttatagaaggcactcaatgaaggaagagaatgaatgaatgaatgaacaaattcctaacttgtgtctgtctcttggcctttgagtatataggtattttcacagccataggaaaatcagatgctataataataattctactagctttctgacataaatcttttaatttccttcttaggaggctagttcacataaataaaacactagaaaaggaaaatagctcttcctggttctgtaagttcaaaaaataaccaatttcttaatatggcagtaattccttgtatgactagctgggctgggactgagaccaaggaccttgacactaatgggccgtttatgaaatttacatagcctgaagtcatcctatcggaatgtccttagtaaccatcaccattgttacagaaaagaattgggaggctttttctttcttgcaatgatttctttagtttttttatgttgtgggtcctatggttgagatcatggtttgggtatttacataagagcaaacagtcctagaagtatgtaataatttctaatgcagctccttggtaaaaagaatgcaacaaatgacacagatctacagcacaacattagaaaaggcgcagattaaatttgaaacaagagcaacctagtgcaaataaaacccttcaggtagcagctttttggagataatcaaatccgtttttagacttccacattttcctaactttatgccctccataaggatgtgatttctgatatgcgtttgtgtgcttttacttgttggtgacttttgaaagaagtcagccctggaatgtagttgccttgcaaaaaaattcaagggaatattttgtaggttttgctgtctatgccttggaagcaaacaaattatggtacaggactggaactttacctacttgttaattggcaggttaaacttttatgagtttctggtaccctggcgatacatgactattaaaatttgcaggtggttcaaggggagagagatgtaagttcctgtgctagtaatatatcataaaagtgtgtatttcatgtgcctgttgtgaaaatggagactttaatactctttcacagtataagctgattaaggaatctttatggatctcattaacgatgggcctttttttcacagaaagtgaaaagtgtaatgcttatagacaagcatagaagaaaataattagcttggtagtgcctctttgagactgagtttagagcaccctctgcattcccttcccaaccctcagaaactgcccttgtctcagaaattgcttctaccacatgaaatactgtaaatctgtcattttatttttactttcaaaagaccgtgtttgcttaattttacttacatttaatagatggtatgtttcctttttcgagtccatgttttcattaggaaatacaaagacatatactgtggctagtgatgtgattccacataatgaactaaattttggaaaaagtgataaggggattgtagttctttggaaactctattttcttatattttacatgtaatcttaggatggaaagctcctcaaatattggctaaattaaacatttgcccgaaaatcttagaagtagatctttgtatccaggagcatagcttgttttagcatagagaaatagtgatatgaattagctttaactaagaaaagggtagtaaagtgaacaatagaaagtattcgttttattttaaatttttagtccataatttttctttacccatttttttttggagaatttctgtctgtttctcttagtatcatcataatcttaatatagcacttttggaacactagattgtgatttagtttcttcactctcttggtaaatatataatgtagtttgaaggtacttcatccattggcacttgttgaaaaattcattctttagaaatggttattttctaaattggtttaacctatggtcagggtgatggagcagcaagggaggtgggactgcatggggccaggggatggagagacttagggacaagatgagtgtgtcatggagaagctgaggaccacaggaaggcattggcaatggacataatgaagaaagaagtaatgctggatgaacaatcctgttgggcttttagctctgacatcagtcataaaaattttgtctcccaaattggttgccaagaacctatagttctttgtttcaacaaagaatgttttctgagcgtgacaattgtgtgcatataattgtatatgataataagtatatatacacacactatttacatgttatatacatacatacactgataatgtactatattttaataaagacttgaatgacctttatggcttttgttaaattagctttgtttttaaaatctcattttaaaatgtgagacagtagtacatacagtagagttgacaggaatgtatttccttatttttaaaggatatattgtgtcaggaaagaagaatcatcaactcttttgacccagtgagatttaagaaggtgggaatagagacttttataaaagtttctgcctaaatatttttttaaattgtgtatgtactccaaatgatattcttatcaagtcttatgattaatatagctttacaaataattcaccattttaatgagggttgtgagaagcaagctcaatgttataggaaagaagtaaaaaaaatagccttatagaattataatcgtcaaggaagtatttgggaatcaaagcctagttttggaaatcatttcttgccaagtgaaaaggtgctaagcttctcagcaagaagtcatttgtagcacaggcttgtctgtcagtgtttgggaggtgctaataagcaaataagcccagagttccagcctgagtatttggtacatccatggagtgctggtgggtatcttaccttagggaaagctgcaagtcagtccacaagatttactggagacctactttctatatatagatagtccccgatgtttgatggtttgacgtaagatttttttgactttacggtggtacaaaagtaatacaccttcagcagaaatcaaactgcaaatacacaatcattctgtgtttcatttttagtacagtattcaataaattacatgaaatattagacttcttttctttttttgagatggagtcttgctctgtcactcaggctggagtgcagtggcgtgattttggctcactgcagcctccgcctactgggttcaagcgatcctcctgcctcagcctcgcatgtagctggggctacaggtgtacaccatcacacctggctaatttttttgtatttttagtagaggtggggtttcaccatgttagccaagatggtcttgatctcctgacctcgtgatctgcctgccttggcctcccaaagtgctgggattacaggcgtaagccactgtgcccagctagctttttaaaaaatagtctttgtgttagatgattttgcccaaatgtaggctaatgtaagttttctgaagaaatttaaggtagactaggcaaagctatgatgttcacagtaggtttggtgtactaaatgtaatttcaacttgcttttttttttttttttttttttttatcagacagggtctcactctgttgcctaggctggagtgcagtggcatgttctcacctcactgcatcctccacctcccgggttcaggtgattcttctgcctcagcctcctgagtagctgggactacaggtgtgcaccactatgcccagctaatgtttgtatttttttggtagagaaggggtttcactgtgttggccaggctggtcttgaactcctgacctcaaatgatccgcttgccttagcctcccaaagtgctgggattacaggtgtgagccactgcgcccagcctcaacttgctgtattttcaatgtatgatgggcttatagggttataaccccatcctaagtggaggagcatctgtgtaggtcttttactaggtgcctgtctgggagaaaatgttatttaagaataggttataaggatttgttttttcttgcacattctttattttctagccagagtagataaataaacaaacaatatatagctcactgaaaaaactataataacaaaaaagtcaaaactacgatggaatgtatcaatcagaggagaaaacagaggcaaaggtttcaggaaaggaaggcttcccacagtactataagggatggtattagtgattgcttgcacctttgttcgtcagctttgtgctatatgccttataaatcatttatttttaccatttagtgccataggaatcctatgatgaagacacgatcatactcctgttagatgaggatccggcagttcagatgtgtgaagtaacttgctggccgttgcatcactaagggactcacgctcagttgtgatttgcttcaaagcctgatctctttattacatggcagaaaacaaagtgaatgttattcataataaaaagtatatgccacatgcaacagggactcatatctccagttttcttagttcaactgtgaggtaaaaattatgtaaaaattagaagaaaaggccgtctagcaaaggaagactcttcatctaatgaaaacttgaaaaaattaaaacaatagtgtaatgaaatggattatttattttttaaaattcaaaattaaatgaatattgattttaaaaactttagaaattagtggaatatgaaacaattcaaactacattagaaacaagtgccagtcaaggttttaaaatatgtccatctttagattaactaattaaaaatgttttagcttaagtaaattgtaaaatttctctgtcaaggatgtctacctactaaaatttcatttaaaggcattcattagttttagctaccaactaaataggaaagttttcatcgcaatttgaagggtatgcaaaataataatatgtaatttcctatagatatttttgttatgaattggtatttgctgcaatgatatcaaaaaaggaaagtagagcagaaggaagcccagacgtctcagttttaatttgaggaaagagtatgtgataagtataatataccactggttctctaggttccattaaaagactgtaaagagaaagaaaagaattctttggaactaatgattccaatctggagtctatctctggatccctaaggattcaccaacttaaacattagtttccttgttgatatttttgaagtcctaatgttaatacctttcccccacttaaagatacacaagacttaagacttaaactgttgagcattttcactgtttattactacatcaacagtatgataacattgtctctcctatatgtcggaagctctgatttgccattatatgtgtctttgtttataaataatatgaaactatataattcttactttatacaatttgcttggtagacaaaatttttgaattaattgtatacatagaggaatagataataaaagggtatattgaaaaggctgggaatcactattctgtatactgtacttagaatttaggtgagtaaaatgacctcatacatcattgcaagactgaggctggtgttttttgctgcctaaaactaaagatatttagcatttgggcattagctaataatgattaactctgtggtaggtgctatatctttgtgttaaggtaaacatactttaatatttgggacttttccttgaatattgtataagccagttatgataagagatttaagtgaaagtgctaataaactcccttcagactcagaccacacatgagaaacttcccctcagaaggaaattagaaggccagagggaagaaattataagtaaatgaacggcgttttaaaactgaggtgctgtaactagaatgctgctaagatattaaagtacttagacatttaaaagacatggttatttatatttaatttcaaaatgtatttaagtgaaaatttgaaaaatatttgagataagcagaactttcagatttttttttcattttgttaaaggaaatatcctactttcatgtattttgcaaagatgtcacaatgatattgaccattatattacctgatgtccattaaaggacaaaaaaagacaaaaagtaactttaatgttttttcttatcaaataataggagacatgtctgctccttactcatccttccttttttttttttgcattggctggcaggaaattaaatttagtattcagttgaggtaaataacttatctcagcctaactacaaggacatacctttcactatgcattttatttgaattttaattcagtaacgtaagtatttagttatatttgctgtctaaaatgccttttagatatttgtaacaaataaattataagtaaacaagtgacctctgagatataaattttttacatcttgctatttccaagttacattgcctgttcttattgaataaacaggttggcagaatattaagaatatcaatgtttacttctaaatacagaaaaacattgtaatggtaggcacaaacgcttcttagaagaaattaagaatgaatataacttaagaagaaaggctctttgttatttttgaagactatcctggttgactttacatttaatggggaagcagaggatgtttgatatttttacctcaactttttttcctcctcttcctttttgtagagaatactcttacttgaaaccctttgtatttggtcctcattctctgctttccgtggcttcctacctcgcctatttgttctatggcctgtgtgcctctttcttttctctttgttagttcctcacccttcttctcattgtgttcccaaatattttcccgaattttacagatgagaaagctgatactcagcggcattaagtagcttgacagagtttacacagctgctaattggtcaaaactgaggtgagaactctaatcctctccctcctggtacactgctctttctaatggcgttacttatagtagaacacgatgctgatagactgtgatgtagttctcgatggcttaaagtgtatgtgtttttctgtgtaaactagaacccatggggctgatgttaagccagttcacactggtacaactgcgctagttttaaaaatactgaaatatttccacattggctaattggtagctactgttaggagcctctcagctgtacctcttccttctttagaggcctttagtgaatccatcaggaacctcacaacttggtccagtggcaatcaaagagaggcatttagctacccatagttggataagatgattagtgtaatacttcatgtttttataaagagcaacgctctctaacataattatctttttggtctgcttttttctcatgataataatgagagggaaaatttattctgctcaaagaatgatgatttcaggttttgctggtttttgttttttaaaaacttcatgtggtgaaacgtgcctgaacagtatatgagaatgttatgatgcagtatcaaggttttctagcccctgtgttcacttaaaattttgcaagtgtagttccttttagagatcatttaaacattttaattctgaaataactgagtatctatatatgttttgcagatttcaagtatgggattactattgttatatctttactgtattcttgctcttttttttagttatagggaattgcactgactgattttcaaatgctaaatcatctatgcatttttttgtgataaacttcacttggtcatgatgtattatccttttaatatattattggattggagttgctaaaattttatttagaatttttgcagccaggctcagtgactcacgcctgtaatcccaaaactttgtgaggccaaggtgggcggatcacctgaggtcaggagtttgagaccagcctgaccatcatcatggtgaaagcacatctctactaaaaatacaaaattagccgggcatggtggcgcatgcctgtaatcccagctactcaggaggctgaggcaggaaaatcgcttgaacccgggaggcagaggttgcagtgagccgagatcgtgccattatactccagcctgggcaacaagagcaaaactccatctcaaaaaaaaacaaaaaacaacaacaaaaaaagaattttacatctatgttcatgaaggagattactattttctgtagtttttttgtaatatctttgtcaggttttgattattagagtaatacctcattggggttaggtagtattacctcctcttcatttttctggaggagctgtgtagaattggtattatattttctttaatcattttatagaatttgcaagtgaagtcatcaggcctcgtattttctctgtgggaaggtgttttgccaaatatttaatgtctataacagatatagggctgttacggttatttatttcttcttgagtaagctttgatagggtttttcaaagagtttgtcctcttcaagttcttcaattcaattgaaaaaaattgtttataatattaccttattatcttcataatatctatagaatttgtagtaattaatgtcacctttggatctccttttttgccagtattttaaataagtggacccactgtctccttgcctatactgtttcctaagaaatactagctgtcattcatattttgtctctttgtgtgtgatttttcttttactgtaaatttgtaaaataatttctcttcagttttggttttgagtatttgattatggtgtattttggtcaagttttctttatgcttcttgtgcttggggttcgctgagatttttggatgggtgagtttatagatttcattaaatttagatatccttcaaatatttttccatcccttgcctttggtgactccagttacgaatatattagactgcctaaagctatcccagggcccactgactttttattatctaattttctatctgtgctttcttttgggtaatttccattgctatgccttcacatttactaatcttttcttctgcattgtctcctctgccgtttagcctatccattgtatattttaatctcatatattgtagttttcactctagaagttcaacttccatcttttttatatcttctgtatttccacttaacgttttaaacatgtaattacagtttcaataactgtcttaatatctttgtctgctattaacatctgtttcagtgctggatcattttcaattcgttggcttttctcctcactatgggtcatatttttctgctttttaacaatcctgataattttttttggaaaccagtcattgtgagttttaacttcttgggtgctagatattttcatactcctatgaatcttagtttgttttggggtgcagttaagttacttataaacagttttatcctcttgagtgttgtttttgagatttatcaggactaatgcagtgtttagtttttgactaattattttctagtactgatacaacacacttctggatactctactgaatacagtttccattatgaagttttctagcatggctggtaggaacagcattcttcctggcctgtgtgagtgctggtcgctgttagctttaggcctctcaggtggtactttctcttgcctcaaatagttcccatacatatatgtattaatttgcactctgctgaatagttaatagagatcttttatagatttttagagttctgtgcctgttcagccctcttgtctctggtgctctatccagaaaactctaactgctttattgtccctgaaatctcagctctgtttcctcaagtctggatggatgtccaccacgctcccccggactctccctccctatgccatcatatagaaatgctctcttggcaacaactttgcacaatcatagagctcaccacctttgtttctcatctctcaggattgctatcctttgatggctcaagtctagaatcttgaaaaccgttgctcagcttttggttttgttcgcttcagggttttagttgtttcaggcagaagggtaaattcaattcctgctactacaagttgaaggcagaacttccttgacacttcatgcagagttgaagtgggaagacttttagacttaactaccaaagtgtccacttcagagagtaaaactcaagagaataaatcctagtattttttctattgaatacacctttatatttacttttttcttttcagaaaataaaaacttgcctttttttaaaaattggaaaagtatacaaaccaaaaaaaaaaaaaaaaaactacagctacacgaacacttaaagtttttaaaaataagataatgaaatagtatgattgtgggtaatttaatagattgtggaagtgttttccaaagtcacatgaaagtatgggtacttacctttaaggatgattttaccaggccacagaacaatgagaattaggaagtttttcacaaaactaaatttattcaatttaaaggactttattttttactttgtcattcttattagtgataaaattttatgcttaattgaattttaatatgaaagctgatgaatcgtaagaatttttttttaatatgatagctgatggattataagagttttgttttttttcttttcattcattaactggcaaaagtacaagagggggtgcatgctatgtggagtccccataacatttttgtactccaatagtctggaaacaactgtttgtatacgctcaaatactttacccatttttattcaaagattgattacctaagactattcagagaagtaatgtttgtttgtttctttgttttgtttttgagcatctgccctgtacaactcatagaatctttagggacaatggcacatgtctgaatggctaacttgtgtcatctttatatgtccttttctttacaccatatagaagatatggaaatcaattatttcattaatacttaaaagcactatttggagatgtatttttaattttcattgtttcctaatattatttctttctattgtatgacaaggaaacaggaattgatttggttcctgccctctttgtcatgaacatatgaccaatgagaaaaaatgcctttttaactatgatattaataataaatatgtgtcaattattgatgtattaagtgtatcattcagtacttatagaaattatttgaagtagccacaattattattcttttacaaatgaagaaattgaggcttaaagagttaagtaactgctcaaggtttcacagcaaatgtaaagccatatatgagacccccgtttgagtcaggcaaagactgtgctccatctactgcctccaagtgagaagataagttttagtgttttccactaagcatttcctggcagtatttctctccagacgctattcacaatctccaaagaggagaaacgactctattctatgcacaatttattactccggttattatacagaactctttatttaaaggggagaatgataaattacactcttgttgaaataagccttgtagacctttgaagagggttggaaaccaaaggaaacagacattccagaagtgtgacccattttttttttaataaatcttttcttttgcttaagatctcctaaaatatttccatttttataaaagccttctggtttctttgtgaaaatagctgcaaggatatgtcactgggtaggttcattaaaaattacaagcatacaccattactatgaaaagctcctatagcctgtttcctgcacattgggaagagtgcagctttccagcgatggtagcccatgaatctcggaggcctgcacctgcagattacagactcaggtacaggcactatgagaatagcccctgttttgtaaaaacaaaaagctctgctagtctatagaaattgttgggaaagagaagcggacctgtgtgagataaacaaaactcataaaccactgagattagataaattgttagagttgtttggaaggccaggcaggaacaaacattgtcttcctaaatgtagttttcctgcacttgggacaagcgtactatctgattaccccagatgatttatttatccttctagactgttgacatgaagtctgcatttcaggcctaggaataggtgtactttctgcagttattttgtttgcagaaatcactgacttctctcatgttactttttgtgattgctagaggtaacgatatcaaagttcaatgtgctcagcttgtctgtaatagtaaaatcttagtaaatcactctaggtttgaaggataggccctggtataataatataacaataaacagagttcctgttctctttatggttttagttacagcattgtatcagtgatacttcagtttcttcttgataaagatttttcatatttaaaactcataaaattcatgctgcagggtaagtaaagtcttctgaaagcatacattcatttacttgtttattcactgactccataaatttttattaagtacccaatttctggcagacattcttgtggatcatgcagactcagtggtgagaagaaaaataatatccctgatcttacagaactcattttttaattgggggaggggcttaaataaaaggtgaataaaccaaacaagaaaatatcaggtagtgatactacccagaagaaagtaaaacaaaatgaagcaattaagtgtgcttggacacctgctttagattgtgtggtcaaggatggcccctccaaggactagcgtgtaagctgatacttgaatgagaaacaggctgccatgcaaagatctgctggaagaacattccaggcagaagtaacagctcatgcaaagatatagcataatgagggcatgcctagacatgcatcataatgccttaccttgtaccttgatttgctttcatttttaccatttaaaattctgcttctgtactatgtcctacctccccttacccttcattatccttaaaattgtgtattcttaatgaaaactatattgttaggtgaccatagaaatattgttattttagatagttgattctgtagtgttttcaagaaattatttcatatttagaataattttgcaaagtgagttagtttaaaagtagttctttaagaaacaggtaaatttcaaaacacttctttccaaaatcttttatctcaaaacttgcattaaaatgagaaaatatgacatctcttaaaaacagaaaaaaggaaggaagggggaagggagggagggatggaaggagaaagggagggagggaagaaaagaaggaaggaaaggaaaggaaggaaagggaaagagaaaagggagaaagagaaagaaagaaagaatgaaaaaatgaaaagaaagaaaaggaaaaggaagaaaagaaagaaatagaataaaacagaaagaacacaattatttttatgtctggaaagatacagggaactttttcccaaatgaggtaactttgaagctgggagacagattcacacgttcataaagtgaaacttccagggcataatttcctaaattatttctttcactgccctcttggtagctcagtgtcacggatgagtgagtttacctcacaagtaagcatttagctcccccaaaacagtctcttaaccttagctcaccacgtgattagactcagggtgaatgcacaagattaatgagagccctgagtgaaaacagtctcttgtaaggacagcactaaatcttgaaaggctggtggttattgtttgtggaagctgagccctggactaatcccagaagggatcatggtggtggtgactcctaatctgggtatatctttcgggcttgatcatgtttttctgtgactgccattgtgtgtctgttggaatctatttttaggagccactgcatatccttgtgttttcttgctgtgcctaaatgtagatccttctattctacttttactccatttattttccagatgatataaagaggacatattctcacatctggaagttaatgccttggttctagtttattctccctccaagcacactaaagactttttcatttcctagcatcggtcttctagtggccaataaaatggcaagaaaagagttgggaaattcttccctttctcctcagtttccccttattttgttgcttcatttaatcctattctatttcagtaaaggaaacacggtctagttattgcaagggagaaagactagaaaggagaagatattggcaactagcaatcagccaagcaatagcaacaagagattcaatattgtcaggtgaggtagcctggttggagaatgcatatgccaattacaaatcgatcataaacaaatacttatacgcatgcagaaaatcctaatctattccactttgcccagtttctgtccatggactaatagtggtggtctctaaagagcactctattaggcaagaatgaggcattgattttataaaacagaatcttcaaaggagggggaagccaggcctgtggggaaagaaagcagaagtctggcaataggtcatgggaaaggaaggaatcactgtggggtttggacttggagagaaaaagtagcagcaggtcacaggccaacctgtcattagctttaagacacacacacgcgcacacacacacacacacacacacacacacacacacagccactgcttacctcagaatggattgggttaaaggttatttttttcccctctcaagactggtttcctatcttaagtttatgttaataattttactgcttctttacagtcctaagtttgcatatggagaggttaggtctcaaaactttcaatctcatagtccaaggtatgcccttaaagtgtaatgtggaaagggttctctttggctacacatgcatcagttttctatcaaaagttattttatagcagactgctattgggtaattgagatgcactttactaaaaatataacaggtttaaactagtggattttattaatacttgtttttgtttttacagtccaattacctagaacactatggtttattcagaacaggtatcttttgtttttatttcaaaaagtacattgattatttttatgaatgtttaaaatttaacagctttctatgcttttgcagagtgaaaatttcaacaaataattttttatttgctgtgattcttttgtaaccatagatattttttatttaagcgaggctatgtatatagtttaagactttgagaaaatcagtaaacctaatttatttctttgacaatattaaaagagcttagtttctggtattagaaataccatcaagacagggctttattcataaaatattacaagatgcttaaagcagtggcttaaaagaatagatttaacgaagcactattttcattttctataggtctgtaaaatattatccccacaacatagtgacataaaacacaactaattatttgctcatggttctgcattttggacagtatttaccagaatggtggtctctgctctcatggcatttagtggaggcttgggctgacaggcctaaggtggcctttcattcttcagggccattccccacatggcctcctagcatttgtagtcccaagctctttacatggagaatggatcccaagagagcaaaagtagaaagtgccaggcctcttataggctagatctgtttaaaggcttggctcagagtgggcacagtaccacttatattgcattatatgggccaaagcaagtcacagtgccagaccagattcacagcaagggaaagtggacttcacagttttttgggatgaattgttcacatttataaggagggaaggaactgttggctgccatatttggagactctagcccaaccttttaacaaatattttgaatagaaggagaaaccttcttaattatgaaggtagttttgatacatatcacctataaatatgcagtaattttatattcactcctaatcttgtaatatgagtttgtttccttgatttggagctatgacattccacgttactgatctttagtctgacaaaaaagagcttgacttctcattcaagtcaatttccaaatgtttactgttacacacttggcaatcaactgagttatttttgaaaacatccccttcaccagtgtagtgaaaagaatatagaggcaaacagatttaggttcaaataccaatcctgcatcttactgactgtggacatttgggcaagttattttaaatgttggggagtaattttactcatttgtataatgaaaataattatacctacttcatcaggatgctatgaagatgaaataaaataattataggacagtcactggacactatactggagggctcatttttcacagttctttatttttactttatataatgacaacagtgctcagaagtggaagtcatgtagtagtatttttgtttgcctttatggctattatgtgattatatgacttttacaacaaaaaaatctaatgagatattcttcttctattaggttttaataattaaaataggctgggcgcagtggctcatgcctgtaatcccaacattttgggtggctgaggcagacagatcacctgaggtcaggagtttgaggccagccaggccaacctggtgaaaccctgtctctactaaaaatgcaaaaaaatcagctgggcgtgatggcacgtgcccagctactctggaggctgagggaggagaatcacttgaatccagacagtggagtttgcagtgagccaagatatcaccactgcactccagcctgggcaacagagcgagactatatctcaattaaataataataattaaaataatagtaataagaatatgttttatgatttcctagttcagaatattctattattgtatattcaaattgcacattactgatgtgttttgtgtcaaagatatttgtgggttacctaggagaggtatatgaaaatatttttattattaattttaatcttgaggtgtagtacaccaatttttttcttgtcataaaatagcatgcagcaagttgaaccttggctttttctgaagttaattggacagaatttgcagacagcttgcaggattgtgtccaagtagattttaaaatttcagaaaaatgcaaaattatcattaacaaaattattatcgcagacaatttcatccaagtagatatagaaatagttgtaaaatgccagtttgcatctgagatgtatcacaatgacactgttttcatagttgaataagaaataagactattcaacaagtactcatgtcaccatgaaagagaaaaatgcagagctgaaggtggcatgacacattttcccattcacagctgagtgggcaggtgacgcgtgttagggagagagctgctatctgatattccactgatgaagcttgtcaactaaattgtatttggagttttcaaaatatcagagtggatgaagtctttggcatattttaacatttaactaagtcttacacatggctccagaggaggatcttccttcgccagttaatactaaattaccagtgctttggcaggaagcagaaagtgccatgtgggtagtggattctggagagttagcattgaaatactcactgtacattacatttatagaaaagattgagaggaaatttcttcctagcaggcttcgtgcaaggtttgggccctttctagaacgaactgcaagtccctttaacaatatccctgtgatctatgcatataggtgagatcatcatatgtcttagaacaggtttgttttgtccttcagaaattataccccttgtgatcaagtccagcctgccttttgccaagccagaagatattttttaactttgggaggacacaacagaagagagatttgttttcactttggacatgactgagtagttgcaggctctcagtggggaatagactcttcataacattagcacagtgatatacggacacacaattgcggaaatgcagatgcagtgttttcatttgatttttggtatagtgtttcttctgaataaatcaagcataattatgagccacatgtgactaaatcagatagagtaattccagggaattggttgatatatatcaagagctttaggagagaaatgttcgtggtttatgtttattattttttgttcatagcaatctctgaaagcagctgctatgcaagtcatttgtcattcttttccactaagtgccagtttgccaagtgagctttcatgtaagtggcggcgtttatgcaaatgctaatgcagtttttaatcttagaagcaaagaacctgaatattttgctaacatacaataacaatgatacttaatattaaatagcagcttttatccagggatagctatataatttacaattgaattggcgcaaattatttacatacattgagggcattgggttaccatatttagatcatagtttatctgatgtatgaacacactgaaaggaaatgtgaaatttgtattcagcatcttcaaagagtagaaaatgactacctcaggcatctaatagccaaaaagtttagtcacactcatacacaccatcttgaaattgcttttatttaccactctcatccttgtttcaagtctagttttatactttatgaatctgcaaatgattgcctttattgaaaggtttgtgttattcaagatgacttgtaaagtttactcaatcttccctagcaagggaaacaggaaattccagagaacactagactcagcaaacctataaaatctgagaaagcagaccattatttctggagacatttcacataacactttgggaagcaatgactaattagtttttggtcttaacaatagcactttcaggggctgttttctttctttttttttctttttatagctttcatattaggaaaagaagaaagtagctctgaatgatgaaatattggcaatgtatgcacttgcttctctgtaggagctcaactctttgatccttcatacaattaacttcattgcctagctggtattaaccggctggagagtaacaaccaattgttgcaggcacaacaacaccctaatatgctttgcctttaatgactgactgtttcaaattgaaagctctgttctctctattcctaaattcctgttgaagtaagttaagtccttaaataagtataggtactcattcacacctacagccttatcttttttgtggcaccttacccagtccccaattgccagagaatacttggtcattagcaggggtaagatgtattctgggttctctagacgtaaacatttgaatgttaggtctccttgcttgcttttatttctttattttttttttacctccttacttatttagtcattcattcattttagaatttgacttccatatgtctaaacacaagcagcctcccttgactcctcttccctctcccaatccacaatcaatctatctttgaatcctatctgctccacctctaccataatcctgctgatcctggcctccaccatggctcttggattattacagtaaccttctcattgatctccttggttttgtccttaatccccttcccctccacctctcatcgcccaccctggacacagtttctttcttcttctttttttttttttaaatattttcttttattgtggcaagaacacttaagagggtgagacccaccctcttaacagatttttaaatgtataatactgtattgttatctgtaggaataatgttgtacagcagctcttttagaaattattcaccgtgcataactgaaattttatacccattgattagcaactccccatgctctcccctagatcctggaatcactattctgttctttgcttttgtgagtttgactgttttagttacctcatgtaagtggaatcatgcagtatgtgtccttctgtgactagtttatttcacttagcataatgtcctcaagttccattcattttgtcgcatatggcaggacttccatttttttaaggctgaataatattccttttatatgtataccacattttaaaaatgtacattcatctgtcagtgtacatttatattttcaatttttttataaatactctaagtgggattgctggattgtatgatagttttaattttaactttttgaggaacctctaccgtttttcatagcagttgcaccattttgtatttccactaacagtgtgcaacaaactgaaaagcttctacacagcaaaggaaataatcaacagagtgaaaaggcaacctagaaaaatggaagaaaatatttgtaaactaagctaaacatctaataaatggttaatttccaaaattacaatgcaacagtaagaaaattaataatctcatttaaaaatgggctaaaggtttgcagggatatttctccaaagaagacatacacatgaccaacaggtatatgaaaagatgctctatgtcactaatcatcaggggaatgcaagttaaaaccacagtgaaatatcactttatacctgttaggatggctaacctcaaaacaaacaaacaaaaacaaaagagaactgttgacaaggatgtggagacattggagccctggtttatcctaaacccagcagccccagtgagcttttagaagtcataccatgtctcttctctgctcagaaccctccagtagcttcccatctgcctcagagtaaaagcaaaaatgctttccagggcccaccagaatctgtggctcccctcactctgattcatctcctaccactctttcctaccatgctggccttgctgcaccatccacatgctgagcacacaccacattggtgcctttgcatttgctgatcccagtgcttagagagttcatctccagatatctgtgtagctcctcgcctcacgtcttcagatctgtgctcaattgtcaccttctcagagaagtttttcagatcaccctgtagaaaatagcaatcctacccacctccaacctacggcaccctccttttccccttaccctgctttctccacagtccttatcaccaactagcaaggcttgttgttttgttacttgcaatcgatctcccccattagaacatacagttcacagaggcagagaatttgttttggaactgctgtattcctagcgcctagaccaaatgtctaccatgatatgaattaggagttcaacaaatccctacttcatactagttgaatgaaaaaattaaataataagtgagtaggaattaatgcctctactttcttctcatgttctttcttttatcttaccctccccactgccacctttctacattgtgccaagttctcatgtctcaagaatgtggtgttttgttccttgttagctgtaaatgtaatactccttcacccatttttatagaaaagttaactttcccctggatgcttgggcttcatcatttaatgtcctcaattgcagatggctatccataagtttgactctgtgtgtgtgtatttgtgtgtgtgtgtgtctgtgtgtgtgtgtgtgtatgtattttaaacttgtctttaccttttagtgtttgcagtaaaaacaaaggagattatagattacgtgtttttggtaaaattttttcatgttgttgcaagtcattcaagaatgaatgcaaagcataaagtttaaacttggagaggcagaaattcaaaatttctttgaaacgaatcatcgaattcctatgctatttagatacacttccattgagtagagagctgacaaagaatacacatttttctcagtggactgaattcttctttaaattaatttgtcagtatttgattgaaatactaaagcaattcatttcagttacattcaaccagcattgcctaagggactacaatgtaaactaatgttaataatttataaataccacttgggtgtcaagaactcttacaggcatttcatacattaggtatttaatatttgaaatttataatagttctataagataaagaatatcatccttttttgatattaggactttgaggcttccaagaggttagtttgccaaaatatacaaagtacgcaaagccaggaatgccaaagcttggaaattgacccaatttgaatttatagcttgaacttgttctcctagactagtgtttttcaaactgtggaccacaacctacagtaattgaatgattttttttggcgatggtgtcttgctctattgcccaggctggagtgcattagcaaaattatagctcactacagcctcaaactcctgggccgaagtgatcctcccacctcagtctcctgagtagatgggaccacaagtacgtgctacaacacctggctaattttttaattttttgtagagatagagtcttgctatattgtccaggctggtgtcaaactcctggcttcaagtgattttccatccttggcctcccaaagtgctaggattataggtgtgagtcattgttcctcacctcaaattctaaattataattatctacacacatacaaataattgaagcgaaagtttcattaagtaaaaccctcaccaggctgggcatggtggttcatacctgtaatccctgcactttgtgaggccaagatgggtagattgcttgtggccagtagttggagaccagcctggccaacatggctaaaccctgtctttactaaaatacaaaaaaaaaaaatagtcagatgtggcagcacatgcctgtaatcccagctacttgggaagctgaggcatgagaatcacttaaacccgggaggtggaggttgcggtgagctgagattgtgccagtgccctccatcctggacaacagagtgagactatctaaacaaaccaaaccaaaccaaacaaaacaaaactaaaccttaccctatgtaacacactgatattttctattctgttccagactaatctcatctagcctacacttgccatgccttgcattgcttatcctatcttgtcctgtcctgtcctgtcctgtcctgtcctgtcctgtcctgtcctgtccagtccagtcctgtcccattcctactcagcccatcccatctcagaacccactaaattggccttgtgatgcacctactgttccatacagtttctatatgcttgaaacactgtggatacaaaataggaaaaaattaaatagtaaggaacttacagataaatgaaaattaatcgttagatatggtaatgatgcgaaataatatattaaatgttaaagccctttgactcttttacttctatcagggcctgaaaataggagatattccttgaatcactcctctcagatactttcaagggtcccggcctgatgaagtcatgagaactagggaaacgactgccataatgtagtcacatcatgcctgtgtaacttttccatttattttttcttcgtccgtgacatgaattttgataccaaccaaaatctgttatactttaattttacaggggtttaatgcatgtgtattatttccccaacaaccctgaggacttcaattcaaggaatagccaaataagatagctgtaaatgagagggctcccaggcaatacatcattcctgatgcaaatatcattgctactaacattattattatcctattatacccccatgatgccttaaaaagtaaatattagataaatacatactggattgatgaatgagggacttatatgctactttcaataaatacgtaaaatacgattgtgggtatgactgtgaatttcatatcaattccttcagactcaaacattaatttttttgtctattgtaagaaaaatcacgaagtcagtttattcagcatttattgagaacttggtatctgtagaaagaacactgtgttgagtactattttcattgcctacatgagaaagtcagaattccagaatgtgtcctttttacctcttcaaacgcatcttctgcaccttcctcctcacatccttctgggcaagtactggttgaagtgtcctgaataaaacaggtatccatgcctttgtgccttagcccagctgtttagccctatttgtctgacaaattcaatcatggctttcaaaatctctatcaatcaaatgttgctttcttcctccaagttaagagttgcacctccatccacctatccatctatccactcaacaaatgcttattaagtacctactacgctccagctctgaactgattgggaagctctgaactatctgccattgggaagcatttctttttagctctgggtacccactggcagctctcccattccatccattacctgtctgtttcttctaatagattgtgaactcttatgaggacatgtattttaacatatttacctttggatttttagagcctagtatgagggtcttgcacatggtagacagtcaacaaatgttgaattaatgaatggagaaacattaaataaaaatggacatagatttctcatcacattcctcatgattgtagctattcctattccttcagattctgggcctttgttaaagcattctcatgcactgatatttgcatcttcccctataattgggaatagtgctactgtctacctactgaacactgttgaaaatttgaatgttcattttgcatgcttgaaataccagtggaaggccgggcgctgtggctcacgcctgtaatcccgtcactttgggaggccgaggtgggcggatcacgaggtcaggagatagagaccatcctggctaacatggtgaaaccccgtctctactaaacaaaaatacaaaaaattagctgggcatggtggcaggtgcctgtagtcccagctactcgggaggctgaggcaggagaatggcatgaacccgggaggcggagcttgcagtgagccgagatcgcgccactgcattccagcctgggcaacagaatgagactctgtcttaaaaaaaaaaaaaaagaaaagaaataccagtggaagggttctgcacaggaggatcatagtctatgattatacacacatcaaaaagctaatccaccctgaccaagtaggctttatccctgggatgcgaggttgctttaatatgctcaaatcaataaaaatgattcatcacataaacataactaaaaacaaaagccacatgatcatctcaatagatgcaaaaaaggctcttgataaaattcaacattctttcatattaaaatccctcaacaaactaggcattgaaggaacatacctcaaataacaagagcatctgtgacaaacccatagccaacaacatactgaacaggcaaaagctgaaagcattacccttaagaaccaagccaagacagggatgcccactttcaccactcctatttgacatactactggaagtcctagccaaagcagtcaggcaagagaaggaaataaaaggcatccaaataggaagagaggaagtcaaactatctctgtttgtagacaatatgattctatagtctctgcccaaaagctatagtctctgctcaaaagctatagtctctgcccaaaagctcctagatctgataaacaacttcagcaaagtttcaggacacaaaatcaatgtgcaaaaatcagtagcacttctgtacaccaacaacatccaagctgagaaccaaatcaagatctcagtcccattcacaatagacacacacacacacctccccaccccaggaatacaactaaccagggaggtggaagatctctacaatgagaattgtcaaacactgctgaaagaagtcagagacagcacaaacaaatggaaaagcattccatgctcattgacaggaaaaatcagtattgttaaaatgtccatatggcacaaagcaatttacagatttaatgctattcctgtcaaactaccaacctttttcacaaaattggggaaaaaaaatcctaaaaatcacatggaaccaaaaaagagcctgagtagccaaggcaatcctaagcaaaaagaactaagctgaaagcatcattacctgctttaaactatgtgacaggctgcagtatccaaaacagcatggtactggtacaaaaacagacacatagaccaacagaacagaatagagaacccagaaataaagctacacacctacaaccaactgatctttggcaaagttgacaaaaacaagcaaaggggagatgattcctatataatatatggcactggaggaactagctatccgtatgcagaagattgaaactcgaccccttcctttcaccgtatacgaaaatcaaatcaagatggattaaagacttaagtgtaaaacctgaaccctagaagaaaacctaggaaataccattctgggcataggccctggcaaagacttcatgacagagatgtcgaaagcaattgcaacaaaaacaaacattgacaaatgggacctaattaaactaaagagcttctgcatagcaaaagacagtatcgacagaataaacagacatgggagaaaatatttgcaaactatgcatgcaacaaaggtctaatatccagaatctataaggaatttaatcaaattaacaggcaaaaaacaactctattaggaagtgggtaaaggacatgaacagacacttctcaaaagaacacaaacccatgaccaacaagcatatgaaaaaatgctcaacatcactaatcattagagaaatgaaaatcaaaactacaagagataccacctcacagccatcagaatgcttattattaaaaagtcaaaaaataacaaatgctgatgagactgtggagaaaaaggaacacttatacacagttggtgggaatgtaaattagtccagccattgtcaaaagcagtttggtgattactcaaataacttctaacagaactaccattcaacccatcaatctcattatcgggtatattcccaaaggaatataaatatttccaccataaagacacatgaacttgtatgtttgtcacagaactattgagaataacaaagatgtgtaatcaacctatatgtccattgacagtagacaggaaaaagaaaatattgtatctataccccatgaaatactacacagccaaaaaaaaaaaaaaaaaaaaaagaacaagatcatgtcttttgctgcgacatggatggagctagaggccattatcctaagtgaactaatgcaggaacagaaaaccaagtactgcatattcttacttatacttgggagctaaacatagaccatataggaacacaaagagaagaacaatagacagtggggcctacgtgagggtgaaggtaagtgggagagtgaggattgaaaaactacctatcaggtgctatgctcatcacctgggtgatgaaatcatctgtacaccaaacccccaagacatgcaatttacctatgtaacaaacctgcacatgtaccccggaactgaaaagtatgaaaaagaaaaagtctatggctatatagactatggtaactagggtcaattaagtaatatttgtactatactagtagcaaaactttcgagagagagaaggtattggaaaactttgctactagtatagtgcaaatattattcatttgaccctagttaccatagtctacatagccattgactttttgttttttacaattttatgttcgggggtacatgtgcaggtttgttatgtaggtaaattgcatgtcttgggggtttggtgtacagattatttagaatcaacttattgtgaaatatttatgcatttgtgcaagctcattcatacagacttcttattttcaatcacaaaacaattggagaaagattaaactagaatatatctatactttagaatggaatagaaacatatgtctagacatggaaagatgtccaagacatgttgctaagtgaaaagagagtgatatgcaatatatatatgtgtatatatataataaaatatataatatataaagagagagagaaagaactggaaaatttatatatatataaagtatacatatatatgaaatatatgtgtgtattttttattgaagaggcgaggtttcactatgttgcccaggctggtctggaactcctgagctcaggcaatccacctgccttggcctcccaaagtactgggattacaggcgtgaacaactgcacttggccgattttccaatactaatattgatgactcctgtgtattttcttttaatatgtatgtacacaacatacatgaagtagttttacaaaaattgattactgctgaaatcttaagtggtattgtctaaagtttgattaagatgatatttttaaaatttctacttcaaataaaattatgcaaattttattattgctaccccacaaaggtttaggcagtaatcttaacggaaaaagcctgcagtctttgaaagttggtgtaatcgtattaggaattcttgtgagtaatggtaaggtaaatgggaaaagatttcccaatttcattcagttttcatttaaaaaatccatatgtggttttgttttcatgctaatttctgatagactgatctttatgaatccatctgtcttaatgattttaagttgtggaattgtcatgagggactgtttggtgcttcacatatacaataaacatttaatttaacgtctttgcacgggaaagtgtgtaaaacatttagcatctgctatgaatggttataccttgtaaattgtaaattcaatagatggtgttttcataaaaatttgcatgtgctaagtgaggcttcattttaatacacaatttatagttaaatcatctctgtgttagcagtaggcagataatgaaatgtagatggtggttcagcattgtttatttattgagggaagaagtagatgaataaggaatagatttgatgtgatgaaaataatgggattgctggtcctgaaattcaagcctggttatatattatttactgattaataaatctaacagatagcatgaatacacatattattaagtaaagattctctttaggatgaaggtcatgtaaagccagagatattttgaagactgtcttcccatgggactgggagttttatatactaattaaaactctgtaaatttcctcacagcactagcagtccagtatcaggttttctgagctgattttaattaaagttgattttaggctcaatttaacttcatttgaagctaaaatggtctgcagaaagtagcctttaaggtctgagggtagaaggagaattgtgaaagagtgtatgtgtatgtgtgcatgtggtatgtgtgtgtgtttatatacatatgatatattcaagaacactaaagcctgccaaaaatatcatatggcttttttgttactgtagtttgtttgagctctagccagaggaacttcagccaaccaaagtcagacccctgaatcaccagtgtgtatctctgcgaccatggacaactcatttcaagcctttgcatctttatgtgctcatctatactctgtttttaaataattgctcccatcaaaatatacacttcagaagtcataagggaaaaagattgcaaatttaatatgttgtaacttccagataatgtgtatatatatatataatctggaaattatatatatataatctgaaagtttatatatatatataaactttatataaagtatgatatgaaatcataccacagtacacgcacacattgtttggtactatgcagtgttcgaaaataattttcacttctctgatgcccttaactgttagcatcatcactgtaatgcaggcaaagataatttataatttctgttggttttaaaaatattattaaaagtttagtcccaaaaatgaaaataattcatacatttatagaataaaaagggaaagtccctctcacaggattatagaattaaaaattattaacacttttctgtatctctttccagatccctttttctgaacatttacacacatgcaccacacacacacactgccacattatataacgttacacacacacacacacacagacacacacacacatacgtagcatatcactgtcttttcacttggcaacatgtcttggacatctttataacatgtatatacactttatataaagtggtatatatataaagtttatatatataataaatttattagttggctaaatatttatatattaaaaataaatagtatataagttctcacaaatcaaactgaatataaacatgaacaaaggatatgcaaacacaattcatagaagaagaaatcagatggccaataaacatatgacatatgcttaagttaataaattatcaagaaaaagttaatatgagatacctttattcactctgaggattgataaaaaatctaaaaagattcctgttatccagtgttggtaatgctatggggtgtgctgggcactctgatatactattagaaaagtttgagggaccatgttttcatttaacaatttaaatataacactttgccagtcattggactttttagaatcaatgtattgtagtgaaatatttatacatttcttcagactcatgcatgtagagtttttattttcaatcacaacacaattggagaaagattaaactagaatatatctatactttagaatagaaacatatgtctagacatggaaagatgtccaagacatgttgctaagtgaaaagacagtgatatgctgtgtgtgcgtgtgtgtgtgtgtgtgtgtgtgtgtgtgtaacattatataatgtgtctgtgtgtgtgtgtggtgcatgtgtgtaaatgttcagaaaaagggatctggaaagatatacagaaaagtgttaataattgttaattctataatcctgtgagagggactttccctttttattctataaatgtatgaattattttcattttatgggactaaacttttaataatatttttaaaaccaacagaaattataaattatctttgcctgcattacagtgatgatgctaacagttaagggcatcagagaagtgaaaattattttcgaacactgcatagtacaaaacaatgtgtgtgcatactgtggatatgacatcatccttagtatttgtacttccatataatgtatattagatgtaactttggatgagtgtgagtaccctccacttaagcagttaatttatcttacattatctttatttatcagatctggtggctttgaataatgctaaatttcgcttctgatcatcccagagaatcaaaatgaaaaggttgccacatgtaggagttttcagtctgtttcattctctctctctttctctgtgactacaaagtgtttccctattctgcttttttcttcatctcttttctcattgtctctaattctaaaaacggttttctataaatactggaagcgcattgtaatttgacttcccaatagcaatgataaactttgaaatgcttaatattgtttaaatcaagacaacaaatgaaaccctgtctggctatcagtcttgttacagtctctcacttaggtaaagactcaagaacttttgcccatctcacgtctgcttcatcaggttcccaacatcctgtgcaccgataatgctaatatgcccaccatcaccttccccgattcattactcgaaggaaccctgggaaatttttggctcaaaaacttcagaggtcctaggtctcattactactgtcttcttattgacatggagacctatttgtagtttgagaaatcaatttagtggtttgaaactggcattttaaacacaagattgaaagtatcagaatgtataatatgtagaaagagtaagagaagtatcatttcataaaactttaatctctttctcgctcttcatacatacacacacaaaacacattcaaatctctctctctctctgaatgtacatacacacacacaaacacacaaaatgtaaaatgtatttctattatgggttgtggtaaaaaaattcaaatcttctattttttgaactgctttcacttaatgatagtagatattacttcacttaatgatagcaataccttcaacttgtattgatgcttgataaaatattttatgaaattcatcattgtacccactcttaatacattatcaaggaagttattcattacatcacttcatcatggagactgtaagagaaattcctgtatggtataaatataagaataactggacattgttttgttttgtctttgggatactgtgaaatattctcttaactaggtttacctcttttttttttcttttttttttttttggcggagtttcactcttgttgcccaggctggagtgcagtggtgcgatctcggctcaccgcaaactccgcctcccaggttaaagttattctcctgcctcagcctcccgagtacctgggattacaggcatgcgccaccatgcctggctaatttttgtatttttagtagaggcggggtttctccatgttggtcaggctggtctcgaacccctgaccacaagtgctctgcccacctcggcctcccaaagtgctgggattacaggcatgagccaccaggcccggccggtttacttctttatattgtaattaaatagactagaactaatgctgtgattcccccataagtgaataagggtttttgtatgcattttactttgtcttatttcagacatttttaatctctgttcttgtttcccttttctatttctgatattattttataaacctactcttgttttctatttcattacccttatcgattatattaactctttcttctaaaataaataacattttctgaagaaaaaagacatatacagatgctgatgattctaagatgccataatcactttgtttgccataataaacaaacacaacaagacatgtaaaactcaggaatttctctttcttagtgcagcctcatatatgtcttcaaaccttgatgatcttttatatttaaatactatcttttctgaaagctgcttgacttccagtctttcatattaatgttttgtaagccaagagttaatgatattaactgctttaattaagtgcattagggacacgagatttggcttctagttccagatttatcactgtgtgctcttggagaatttggcaattcaatggacttctctggatcatgttccttcatctataaaatggatatgataatatcaaattctcataaaagctgaagggataccccagatactcaaagttctttcttaggtctaacatttgtatatcaaagaacatgtcattctgttcgtttgttaatagcaacttcataagctcttttatatccagtgctgtgtagacatctgaccttttttaaagaaaaaaaagtattccattgcttcacccacatcacatgtcagcttttattgtaatattttactggaacatttatctttctctttatttttggattaccttttatcttttttgaatttttagtatcttagcacttgcatgacaatgaaaaatgttaaatgtttaaataaatatatttagaagtattaggtgcatataaaatacacacatataagcacatttaaaatctccatatttttctatatagtggtacaacacttgcttggaaataacatgaagtgatttatctcagctcttattttcacacatgcataatatagattgcaaattgtgttacattctgaggacattcttcagtattcacttgtttggaggtgagactctcaggagacttatgttttagaaatataaaacaaaagaaagaaaattatttaagaatccctctcttcttccacctatcttccatccagaaagggacatatatatatacacacacacatatatgttttgttgttgttgttgttgttgttgagacggagtctcactctgtcgctcaggctggagtgcatggcgccatcacagctcactgcaagctccgcctcccgggttcacgccattctcctgcctcagcctcccgagtagctgggactacgggcgcccgctaccacgcccggctaacttttttttgtatttttagtagagacagggtttcactgtatttgccaggatggtctcgatctcctgacctcgtgatctgcccgcctcagcctcccaaagtgctaggattacagacgtgagcccctgtgcccggctgggacttacatatttagaagagatacagtgacatagaggggaaattagttttcacagattttcaattcccaatgcagggattcttcaaagtcagagcaacctacagatgatagatgactaccaatgacaatgttttgacatcatatttacaggatttctttccggtcaacattgagcattttctacccctatgtataagagtggttgggaagacttctaattttttttcctgtccattcatctctcttacaagatacattattttgttgtagccttaagattcatattaatgcttggaaataaatttgagacaatagaagtgaccaaatatttatttccccaccagttgccggactcacattccttcaaagctgagacttccactccatgctatcatggtacatctccctctccacctttccccaatctttgcttaatgtattcatatgctcattttatctccattagggaggcccaaaatcagtcggatatcttagcctgcattggatcctccattgtctgaaatactgtactacagttgtcctcagagttatctgaactgacctatgtctgtattaaattttatctttttgagtgaaaggagtttatactgtcttactactttacaatatctatttgtaattctttagactctagtgtcatggaaaagctgtattttttcttctctctgaggttttcagtggttggatagtcaagatagcgcctggttaattagcagctggtttgtctacctccccagaggaatattcagtcctagcccaaccacaaaagcacagcttcaaacagggaaggtgactttgttgtgagtctaataagatcacaaggggctatatttggggcttcaactacagtggatggcctaggcatccaggctgatagctgattgactcctaataatctgaattattctctcaaaacaacacaactcaatgggagctactgatttgctagggtatcataaacagaaagagaattaatagtagtctctgccctgatacaaatccacttccactgaattgaaacaaactcagtaatcataaactagccaggaatggtgaagacctactttgacctaaattggcttattgacttgagtttttttttctgaagaaaatacctcttattgcttatgattataaatttccacagggattagataaattatattttatcattaattttgtgtacgtggcaacatgattggggaaaattatctagtgattaaatgtaactgtatttgctttgctagaaaattacaccaaagaagaccaatgggtaagtagtctcacctctcttgtaaataccagattggaaactgggtgtgttctaggaagaacacacatgcacctcataaaagtaaatagaattaaatcaacaagaagtaagcactaattataccatagggtgaatagtttttaaaaagtcttgtcttttcaattgttagttatggtccattctaaaaaacatgttatgctcttataacagtgaggagatcctcaggggatgaatattagtaaaccctcaagacatcttatatatgaatatttggtttaaaactaaatatttaactctttgtgttaaatagcagagtaccacccttcatttgtaaaatagaattcaagatcataaatatgtgttggatgacagtagaacccgttttaatttgtacacacacaaacattatgttctttctctccctctctgtgtgtgtgtgtatatatatacatatatatatacacatttgtataaacatttgtatatacatttgtataaacatatatacatttgtataacatttgtatatacatttgtataaacatacatttgtattatatatatgtatatatatgtatgtatgtatgtatatatgtatgtatgcatgtaagcatatatgtgtgtatgtatgtatctgtctatctgaaggagaaaagtttcatgctggccactactaacaaaggtgatttgcaactgggcatggtggctcatgcctgtgatcccagaactttgggtggccaaggtgggttgatcacctgcggtcaggagttcaagactagcctgacaaatatggtgaaaccccttctctactaaaaatacaaaaattagccaagcgtggtggcgtgtgtctgtagtcccagctacttgggagcctgagataggagaattgcttgaacctgggagaaggaggttgcagtaagccatgatcatgccaatgctgcactacagcctaggtgacagagtgagaccctgtctgaaaaaaaaaaaaaaaaaaaaaaaaaagagtgatgtgctatcaacatcaataatgaagtacatgtctcaatagacatctcagtttgtattttctacacactcagttacatatcttgtaaataaaaggggaaaggtagattagtattttttatcccccgaccactgtatatcccatactcatcttagtacttaaatggctatttccaaatacattcattttcttaagcatatgggatgagttgatggtatcctagatacaaaggagtctcattattttattttgccagaacttttttcttccccacaggtttatagtttcatagttctttatagtatgctacgcccaaaggaggcatgaataccgaaataaaaaagtgccaatgttaagatacatgttttgcaccagaatataaattttcgcattggttgactgataacactgttgtattgtcatttttctcaaagtaaggtcttactaagcctgttcttgaccattaccatcaagtaccattaccatcaagctatttataatctttgtatttagtttctatgtactagcaatagaaaatattatctttctcatctctttcatttagtgactaaatttccctagaatatacaagtgatctaagacccagggctggaaatgggaggtacatgtgagtttctcaaattatgcaagagctttatcatactatggcctgaaaaattcctgcatagtggccattgtctgtcttatagaaaggcaggagtttgcattcaccaaataaacgaaacaagaattcacagctgcagaaaattgaattacacattttcttaagacaatagtcatatcatggcaacagattacctacttaatcaactgtaatcaacttttagtaattgtgaaggtaaagttagttctattagctcaactcaaaacttcctttaagtagtaaaataaatctaattacattgagttaacttttttgatgactatagttttctactataggctatttttcaatgagttgaataatttgcttatatatttatatttttttatgatagtgttaatcaacttgacatatcaagaggataataattttctgctcattaaataatatccctaactatattgtcaaagtactcaaaatttaatgctgaaatatgtaggggctgagcggcctctgtgattgtttcagattgcatcttccattgttgaaagaattacctgtgatatcaattaatgttcatagaattttcggagccaattttaatgaaaagttaaacccagtactgtttatcagtgccagtaattgctctcctgtatgttataaccaggcctatctattcccaaatgccccgaggcagagctgtttatagatagccatgaaaacaatgttttgaaacttcagcttgcctgaatcaaaaacctccttttatgcatggttagttaaatcagccaaaaagatagttgacagcaatatttgaaaatatcctgaaaatggtttgaccttttcattaggtgctagaaataaaagcagagaattaaaagaagacttctatttaaccttttgaacaaaaaccggtttacaagtcaaacatatcttaggattgtgcgtgagctgctgatgacatagacactcatttgctccttaaagaacaaaatttgagcacaaggaaagaaaacctttctctggaacaagtaagctctatttaaaaagtgtaggtctctatttaaagagagtagggctggcaaaggcctttgtcgtctggccagcaaagaggataatgtgcagagacatttaaattcagtgggacaaacactaccctttgttggctcccacactctcagacacacacacagaacttccactaaagtgagagaactgtatctaatttggaattcagaagatggccaaaaataaatagtttattgtcatattcagatattatattcatggttttctaggttggtgtgtatgacatcactgctttaaacccagccatgcatcagcattggtcactgttctttctcatgcctagtcggggggtgggtttaaaagaagaaagtgttgagcatagatttgacaggacttgaaaactgggaaaggtttagggatacacttttgagttgaatcttttcctttttgctaatgctgcttctcatataacgtatattcaaatatattaggttttttaattacaaaagtaatacttgcttattgttttcaaatatattatgggtaagctgttttttaaaaagtgaaactgtctttctgcctctatgtccacatcctcagcaaaagcactgttgatatagtttttttcaacctttttgctatgcatttacaaatatacacgttcttttgtgtgtgcgtagatgtagaacatatattccaagtgtcattgagaacaacatatattttcctgcaagatgcattttttgaaaaaaacttggaaatatcaagggctgccttctgtgttaaaagctataaatactttcaacagattatccacagttgtacattatccacaatgtaagtgtaacatgattaatttttttcctaaggttggatatttagtttctctaaaatttttcactactatgaaaaaaagattcaacgtatatctaagtatatgctaatcaataaatgcttgtgaccatgtgagctttacattaaaaacaaaaagttttgaatatttgggtaaatgttgaattcccatcttgatagattctttcaaccctaaaaataagataggattactgacgtctttaaaataatggaaatatttattggccctagtgtatctgtggtatcattgaccttttaaaaaatccaaatctagatatgagtcagtggtgtgaaaacaaaaaataacagagagtttaaaattatttatgatgaaatatactgacacctaaaataacccccatgtgaagaaatatttcacactttattttaatatattttttatattttacagaaacacttatatatcgcttaccacaattatggtcactaatattaacctttttcatttaccatttttttacttcagagataaaaataaaaccaataaagttatgctgcttataaaacagaagaccttgagatgtgtctagttttattatattgttgtggagccatttgtattgttagcccatgtagaggaaaaacagaaatgcagccacgtccataattccttttattcatgtgtaggttataatttgaaatacatcagattaatgatcttagtcatgcaaatttaatttataaagttgagattattttcaccaatacctaaaacatctgtattcagagtttttgttaactatgctttattatccaggctgaatattgtagcaagaactttatagttaactgtcatatacatctcagaagactggcatacattttgtgaaatctatgaatttgattgcttaaaaactcctttggctcctatagtgtatgtattcctattagaatatacaattgaaagaacacaactagagcgtatacaaaggggagtggttaaatcatagaggaccctgtcacccacgctgtagtggagtggcatgatctctgctcactgcagttctgcctcctgggttcaagcaattctcctgccttagcttccctaatagctgggattacagacgtgcaccacaatacctggctaatttttgtatttgtagtagagaggaggtttcaccaagtgggccaggctggtctccaactccaactccaactccaaatccaattccaggcctcaagtgatccacccacctcagcctcctaaagtgctgagattacgcgcgtgagccaccatgcctggcgatctggaggtattctcctgtgaaaaagagacaactgtgattgttataaattattccataaactcttatgtgggaaacacattaaatttattctgtatagctacatgaagccaactaagaccaaagagtagatgttgaaaggagagcaacgttcaattttagtttaatccttaagaatatgttctgcttatattaataacaataatgcatatttatcgtacaaaatgcaagaaagcattaaaagaaaaaatatcacctttgatcccataaccaagaaatggtttggtaccttttctttaaagattttatatatgtatggttgtattcaaattgagtattaattattagatttctaacagttattaaattgcatagggaagagagggtaacgtaactattttatggtaaattgaacatttgtaataatttttttatttaaatattccacttttgaaaatggacccattccatcagtttcctttttggtcaatttcctattcatttctgaaaacaatttggaagagactcctttcaaaaatatattgcaaaaatggtacaaattaatttgcaaagtcaaattgtgtttttttggaaaggattcaggattttattgctaaaagtgagttggaaaacaacttggactgcaaggctcctgaaattctggtagaatttgatgtgttgatagttcaagaagaccaaacctacaagatttgtggcatagtagatgcttaaaaatataataataaagtgacagaatcggggcagatagaataatttgcatgtcagaggaataagaaaagctcttgggccaattaataggccctagagtattttgtcaaaactgaagcctgtgatataaaatcttacctttttgtgctggcaaaattaagcccaaaacactttataataagtaagtctgaacgtatgtataccttaagaccctgcatacacctttagatacatatccaatagaaatgtttacactaaatgtgttttccaaaagtacatgcacaagaatgtttgtagcagccctatttatagtagccaaaaagtgagagcaatgtgcctcaaaattagagtggataaattatgaaacattcatgtaatggaacaccatacagcaatgaaaaagaatgagccattgttacatacaataatattggtttaccttacaaatataatactgaaagaaagtaaccaaacacaagagtgcctactatatgactcaatttttataaagttaaaaatatggtcaaaactaacatggggtgttaaaagtctggctagtagttactttgagggtattaatgagagagggcacaaggagtgctgttgtggtgttcaaatgttttctttcttgatctagctggtttattgggagtgtttacttatattaatacactaagatatacacctatggtttgcccgcttttcaggatgtatgtagcactggaataaaagtttacataaaataaaaaagtttccccaccatggctcttccacccttcacaaaaaatactttctccattaaagaaggagctcagagttataaatattactgaaaattttattaaagatacatttaaatatactttttaaatgttttgtttaattttgaggaaaggtcttcctcaagtttattataaaatttaagtttactaattatctgtttgcagtatctcagataatgaaaatctccaatttatacctctgctctatactcatgtcttttctatttaacaaaattagaatcagacttttaaaatatgtttcacctattattctgtttttgccatttttcatgacattaaatatttccaactgaaatacgttctaacaaaggtgttaacaaatgaaacaagtatctcaaaagatcatgctacctctattaaatatttgagttgaggctgcatggccacttatgggagaagtaagtggactcagactaagatatcaatgcctggcaaatattgggctgttcaatgtgtctgtggaatgaattaatgtttttggaagtccttccaactctgattgcctagaataagcaaagtcagcaagattattgtgaaatgctcactcactgacactaaatggtacataacagtgcctggttctaattattacatcaacatctgtgattactgattcaaccctagctctttgatatttattcaccaactttgccattgttttaaagatagatgataagcaccatgaatactgatggaagcctttgcttttggcaaagggtagacaaggtgtctccaaaaaggctttatttcagcggcagaagaatttctaacagagcttgtaaacttatttttagtctccgcccctttcccagttctggttacagggcagacacttttagtaattttgcttgtctgataaatgattctatcattattgatattgttcttctcttagccacatgtgaacacatttgattgagactttaagaaataaattatttcctatttcaagagtgcttctcttttgttacagaactcagaggtctgacttggaattgtgctttcattgtttcttcatattcatactataactaatattgctaatgccaaactttttattctattttttaggaagaggtgaagcttcagagattatattgtgattggtcagcttcttaatcagaaggaaaggagtgtttgtttagatatctcatacatttactttttgactgctatgcaacaagacatagaaaatgagggtgaaagtgtcaaagggaaaagagtagtagatgtcaaatgtcatacgtgtttctacatggatatatgttcacatataggttatgtatacatatacataccgctgtggtctgaaagtttgtgcccctccaaaatttatgttggaacctagtcaccattgtggtggtattaagaggtaaggtctttggaaagtgattaggtcagaatggccttgccctcaagaatggattagtgcctttacgaaacaggcctgagggagcttgtgggcccctttgccctttcatcatgtgacggcacagagaaagcatcgtccatgaggaatgggccctcaccagacataaatatgctagcccctcgattctggacttcccagcccccagaactgtgagaagtaagtttctgttgtttataaattacccagtctaagatatttttgttatagcaggctgaatggaccaagacacatgtatatgtgcgtgtgtgtgtgtgtgtgtgtgtgtgtgtgtgtgtatatatgtgtgtgtgtgtgtatatatatgtgtgtgtgtgtgtgtgtatatgtatatatatatgcatacatataggtgagtatattggattacattagatagatatgcataaataatggagaatctcgattggccaggagtagaaattatacagtacagatctgacatgtggatttcccagatataatgcatccactgatgcattgtatccactgatttatgtggatatagaggtatccactgatttatgtggatattatttgtatccactgatctatgtggatatagaggtgcttcggcgggggttgggtggggggaaacatttgctattcagccctatcggcatatttggtgaactgtgtgatgtgagatggcttggagaacaggcggcacattttaggaaggagtttgtggtccctaggaaaagcttcactcaaagaaaagagtctggctcagtgacctggaattaaagggcacctggacactaggggaattatggctttgggaacagcatggcaatgtcacctaaatctgccccagttcagccatcgttatggtagatccatatcccagatgttaaggactgtgtggaacctaaaacagatacttcactaaagtattaggtctcaagtaactttgctgtaggatccatctgaagtccggagtcagcatttgaacttcagttagcagccttgagatgctagccagggcagtttgagtggccattgggcagattatcaagatagaattccaaggtcaacagcaaagtgacctgaatcctaggctgaactgtggtagccacacactccctgagcctcatgtagtgatctttcaagaccaggaacaaccaaaatgagcactaagaatgtggcccaaggataacatagaagtggcagcaggaacattgtccaggatacgtcagtaagaacacatacgcgtatgacactctgaggaaacaagcagaaatatcagaagtgagccttggaagttgaggctcatgtcttccaattgagggtcacaacctggagtgtgggcttgatttgtcaaaggacctttgtgggaaactacaggtgggaagacctgccatttgcatagagaaagagaaagaacatgtgaacagtcttataagatgcagacttagatgcatcaatatataattgatatggtttggctgtgtcctcacccaaatcttacctataattgtagctcccataatccccatatgtcatgggatggactcagtgggaggtaattgaatcatggggacaggtttttcccatgctgttctcattatagtgaataagtcttacaagatctgatggttttatacagggcagttcccctgcacatgctctcttgcctgccgccatgtaagatgtgccttttctcttccttcacgtgtcactgtgattgtgaggcctccccatccatgtggaactgtgactcctttaaacctcctttcctttataaattacccagtttcgggtatatctttattagaaacattagaacagactaatacaataatataaacttggacacacataatataaactaggatgctctatcaaggaaacaataaaatgttacctttttttcccaatgtaagtttaccatgattttgcttttttcttattcctgtgatgctttttataaaataaattataaagtattcattgaatgaatttatatcttctaatcagaattttccttaggaacttctctaattgtgtagttagggtaaaaattgctttgtatatgcctgtggtttcaaaagactggaatgtgctatttatctttttatttactgaaggttttcacttacttcttatgtatttcttatactgtattaattctaaagtattaacctatttccaggtgtaatgatgataagtacacaaaggtcagcattgattaaaaaaagtggggggaaggaatttaattctggagctaaaatccatttagttaaacagatcaaggacatacattaataggctgctgcaagcacataatagcctaagacataaataggcaaatatttttttccttggatgttaaattcacagtattcacagtagctgcctagagtattatgttaagaaagaggctgaggtttgtcggaaaagaattagtagtgcttatctgggagtgcctaaactagtgcctgggaggttgtggtgacacaagtgccacatatttgctaatccttgtctaaagcttcccttaactatttagtttagctagttcattaatactatataatatcataacttattttgttttgtttttcataatttgtctacagagattacattattttccaaaatttttgtatagattattacaaataagtaaatgtcagatattttatgcaggtatctggaactaaattatcaatatttataaatatgatctaaatcaaacagtacacttgctaaagcaatctacagatgaaaaccagagtctcatttagaattgcccaaagacaaaagggaagggactcaggagccttgaataaatggggaaattgttccttttcaattcagttgcagaaatatttatttagcaagtaccaagatattctcggaattagattatgcactgagagcctcataatctaatgcgaaaacagacatattattccaaagtataattgcctaaattaataattatagaattgctaaaattttctgaagtgttaattatggaattactaaaagccagcttagatgtaacaaaaaagatctaggaattgtccgatacatttattaatcttatcaaaatactggagatttacaaaatcagagatttttttacttttgggctcaaaaaattgaagttcttcttggacagtgtaattaatcttataattttaggtaggtcactcgaattttgagattaaaactctagaatactttataatagcagtgttttatatttgaatagcactttaaaatttgcaaagtgttatgttttcagatactttacttggtaatataaataggtcaagtactgtcttcacttcctatgtaaggctactgtggctcagaaaatttaaacaagttactctagtttacaaagccagtggagttggaagtcaaacccaagtacttgggtttctaattccaaatcctttctttatgttagagtaagctcaacataatatattcttgaaagcaacttagaaacatacatcattataaggtaaaataaaatttatttatttacttttcttattgctcaccatgtgaagaacctgtgaacagcaagaaactttctttaattccctaaagaaaattatcttataccttgttatgcacctgctattttcagcatttatcctaaaaaatgtggcattggataattaaccaattatatgaattttatttaactgttttgttgttctaattatggggttaaatataattatttttctatagctttgtaaaggaaaacatcataagttaattttcattgtgtatcttggctcttgctgaggaaaatattcaaaataaaagctttgtcttacctaaaaatggaggaggatggcgtcagaatttactgtcatcttaactgatttctaataaggtgtctctgaacatacaggtctcacataattcacagctgcctttggtcttgattttttctttcttttttctttttgaaaactgaatatttttttactttatttaaagcccaatatttggataataaaaaggagacagggacatagaaataagtgtagtaaaaaagccagatatcttcctgtttgctctaagaaacttaatattctgtagcttgtatatagtcatgtaaataaagataaaattagttctgttttttcagtttaagttcaagttgatatttgaaatagcttttaaaaaaaaagttaagtcaaacccaaagaatcctgtaaaccttttactggaaatatttatggctatgatatccttgtccctttttctcatttttttgtgtaattttagccaggacattgatttcattacacaattgaagaatcctgtataattacagcatttaaatgaaatggaaaaagaattttgttactggtatttatctttttttccaaactgagaaggaacaattcttacagtgagaatctgccagccaggtctcagtgttgattataatcgtattttaaaaacataaatgaacgatttttatttaatcattttccaaaggatggattgaagcacaaaatctgttgcacacccagaagacagtgcaagaatggactgggttggggatgtagccaaccatctaattacaccaatagattcacagcacagttgggtcacaaattatgtttctaaatttagaaggtgaatctccaccataaattattgaaaagcactctgtggtactcctctctccatttcccacaaattagattactgaaagctataaagcatctttagaatgtgttttccttgctgtttaaaaatgttcctttatcatcaattagtgccaaccttgacatcagctataaccagaaaacattgaaaccaaaggataaaataaagaagcaaggaaattatttctaaaagaaacagaagaagcttttttacttgctagggagatttaactccttaaaatatttgtgagtttccatctctaaaattttcttgggatagaaatgtaatgacatattacataaatagggtccccagcacattttatttccttgctgatcgtattaggtaaaataattacagctgagctagaacaaattttgataaaataatttcattctaccataaattaagtcatttgcattatttgtccaactttacttttgatttgatttgattggttggttggttgatttttttgagatagagtctttctctgttgcccaggctggagtgcagcagtgtgatctccactcactgcaaactccacctcccgggttcaagtgattctcttgcctcagcctcccaagttactgggacacaggcacatgccaccatgcctggctaatttttgtatttttagttgagatggggtttcaccatgctggccaggctgatctcgaactcttgacctcaggtatccacccacgtcggcctcccaaagtgctgggattacaggtggtagcaaccaagcccagcccacctttagtttttgagcttatatatactcaccactttcattcatatgatttatgaacctgaaaaacagttgatggaagatattagaaaataagattatgtataacattacactaaatttaaggtttggcctctctatttcagttatgattttctctacaccacctctcttcctgtgtctataaaatgggaataacaatccttactgtgtacttacttaaatgggatgattcgcaagttcctcgttcacaagagatttttcaaattgttttttattttctaaattgaatatgcagtgatgtgccatgcagaactctggttccaagttaaaaatgtccaattcaaatagctgcagggtatttattggctcacataaacgatggccctggaagtagaaccagctttatatatagctatactcgggagtcacacatagttttatccaccttcagttttgctacaaattgtgttgtcctcaaactcaggttttctggtatagaaagatggcagtggagctcaagtgcctaccttttctgagaccttagtctagtagatttccattcccaggattccttggagatacttgttgaatctcagagattttgattaactcagcatgtccatttcttaacccttgctaatgagaaagaagagaataaagcttttttcatttcatatcccagaaaatgtgcatgcagttctgctcccatttttcctacagtatttcaagtgaaccactcagtgacaatcccatcaacttatactgccttactcttttaatttaatatgaaatagaactgtcattaactgaaagggaaattgcttcagtgaatatatttgtgaagaaataaaattgcttcagtgaatatatttgtgaagaaataaaattcatgagatattataaatttgatttgccttcaaaattttaatttaacttttaaaattagttacaaaatatagttttaaaaataatctaattattcataaacttttaattgagagtttctttctgattagttgctgtctgcccctgtgcagctgacccattatatttacaaattggttgatctctgcatataggccataatagttttataaactgtaggttataaacgtctgctctaattaattttctttcatatcaactgaatttgatgttgttgaggcattagtgagttttttaaaaatagtttacatagagcttcattttgttgattagtcaaaagtattgttaaactggcttcatggtgtttgaaatcacctattttcaggtgataagactttctaaattgatttttccttgttcctggatgggtcttattctgccagatgggagttagatcacttccattgaaagagagtctgcatgtgttcccagaagcacacacgtgtatgcaaatgcacacactgacactacagagtctggttcgtgtgttctttctcactatctgaggttgtgtatggccatacacgcctcagatggggttggtttttataaaaacgttaaggctgaatcatatttgttgtattgtgacatttgctgccttgccatcaaagagtaggtgcctttgtgctgacaactctttggcattttgccccagggaagtgttgcattatcaaaagagacgctcaccctctcagtgccagggtgctggtaattaaatcgtggatggttgaccagaattcacaggtgaaaatgatgaaaagaatgtattgaaatgaaaacctgaactaggcagcattatatctaatgagcaagaggagagctcttttaggcttggtaacttagatgagcatatgtgaactatggctaatgcttctgatagaaaatggttactaggaaaccataaaaaaccctctaattatgtgacctccaagctataccaataaatatagaattcagatgagtttgtgctaaaaccagtagtaacccactaatattattaatactcttgtagtttgtttccaaaggaagtaagatttattgtccttttaagtactggataacaattcacaaagattgaatttatttaaaagttcatagccaatgctactgtgttttaactgatgaattttggtttccttttgcagtgttctgtatcatggcgaaaggtcacaaaataatatcttgctatcaaaacttttttttgtggcttaactaggcaaaacttcgattaataaatgataagctgtagacctctactcagagtagtaacaaagagagagctggaggtggtggctcttgcttgtcactccaactcccatggagggtccttccttcttcaacctgactttcttatccccacagacctcatgtggaaccttgtaccatgggtgctattctgtggctgctgtaggatcttcccaggtagaaccagaccttatcctttttctttggtttcttgggagtagagctgaacatgagtgggtgacttccttttccaggctattggtcaaagctgcggtcagcaacaacttggccaagatatgcttgacccagttttgccacgggctactgaccaagaggttgctgttcggagttggcatgagtcagagaagcaggttaccagcaggttaccagctgggcaaaactcagatcgattagacatatcttggggtctttttacccctctctactcgtgttataattttttatcttaggcccctgcattccttcctctccttagccacaactgcctgatatctgttacttcctactaagttttaacagataaaccagactgaggttaaaatgctaagaattaactcctcttcccagaaaagtgtaatagaaggatactatagtggagtgggaatttgataggaaagcataaaattatattaaactggtaagtgaaaaaattttctacaaaaatggtgagtaaataaatagcattttggtagtttacatgctcagatgctttatttttctagtttttttttaaagcatttgtcttctggggaagcaattttataacaggtaatgtaagcttcctttgactgactgtaattgactaatggcaaccacagaaaacagcccttagccttcaatttttgctcccttgccagtaaatcgtcctgcctggggtgatgatttaattttcatggtattcaaattacaaattaacatttgcaagtgtagatttgggggattatgctggagcctagtagagttctctaaggatagtgtgtccccttgggctacatcatataacttccttattaaagtgaaaggaaattcccttttggttttcttacagcttttcttcctgtcctcatatttaagaaaggcatccatctattccactttaaatatcaagcttttcttatatcaagtatttcagatagtcagtttgcatactgcttatggatgaagttaagggttttggaaatgttagcctacagatttgcttttttttttttttttcgagacagaggttctgctcatcacccatggctcactggagcctcaaattcctgggcacaggcaatcttcccacctcagcctcttgggtagccgggactacagacatgtactaccacgcaccactgatctttttgactttttgtagagacaggatgtcattgtgttgtccaggctcgtctccaactcctggcctcaagtgatcctcctgcttcagcctcccaaagttatgtttgcttctaataatcatagttgttcatgagtagaaggtataattccagcccatcaccatactgatgataatttatagcattatttgtacttgtgtttgtagtttaacctgtgtggaattatagagaggaaacaaatcttttgacaggggctaagcttggtttcagggcagaataaacaatatttttttcaattatataaaattttgtagaattatggtaaatagcaactgcatttgaggaccaaaattcaaaggtttctgtattttatggaattcgaattcattctattgtattaagagtagattatcctggggccaggtgcagtggttcacgcctgtaatcccagcactttcagaggctgaggcgggtggataacctgaggttgggagttggagaccagcctgaccaatatggagtaaccccatctctactaaaaatacaaaattagcgaggcgtggtggcacatgtctgtaatcaatcccagctactcgggaggctgaggcaggagaatcccttgaacccaggaggtggaggttgcagtgagctgagatcgcgccattgcattccagcctggacaacaagagcaaaactctgtctcaaaaaaaaaaaaaaaaaaaaaaggagtggattatcctgaacccaaatagaaagtatttgaagggaaagactatgttttcctgtaaggtagattgagcagaaaaattattaaaacaacctaatgatctactgtgactaacattttgcaactcaacctatttaataggctctggaaaataagcaatgatttctagagaagagtaaaaaagccagaagaagaaaattaaataagcggcactctttctgtggggaagcctattaaccgtggaaaagaataacaaagttaggcaaaagaagcctacaacaaatcttgcgtatgtgtacgtgtgcatgcgtatacatacatacacacatatatttctctcagacatacgcagacttttcagtcagaaaaaaaaggctaaatgttggaaaccagtacttaattgatttttagaatgcaaacctaaccctttttgacatagattgatcctattacaaaattcataaaatttaaaaataaaaatctgttatgtaatgcttaagtagatattggtaatttgggattaagtttcagttaaaatggtaaagggagaattttagtggaagtgtttattgtaaaattgaatgatactaaaatattttgcttacaatttttttaaaagtccaaaatgcttaaaaagttttggtcatatccaatatttcctaaaatgtttataatattgtaacctggtagtgtgacatttgcccctcattttgttagcagctgtattatgctctctaataatacaatttcttttttattatgtaaatataacactgaaattagtactaggaaaagcaactgcgtgttaaaaaccatcatattttttactggcaaatttggactgaagttgtcactttgtcacttttgtcattgcctacctttatctccagggcagcatctgatcagagatctcccttaattattttaagatcactgtgttactgttagattttttaaataaacatttagatgaaatatttgattaaactgttacactaaaaatgtgtttaaactaatatgactttagtcagtttcctatgatgataatgtagcttacatgtaagggatgcatcttatgtaccagacattcagctagacagctgacatagattatctcatttcatcctcccaaatgtgaggatgagaaaacagaggcctggagaaactgagcagtgtggtcgtgatcactaaattagtaaatggttatgttttgactaagtatttcttgttatcatgtaatactatctatctcctttaaatagttataaaactcagagtttacaacttctggtcttaacattaaaaaaaaatcatctggaaattatgactatcatataaaagtatgttttaaccttcaaataatgatgttataagcaattccatcttcacagtcacccgccagtatttgatctctgataaatgaattgtttgttgcacacagcctcttagcttctttcctttgtctaggcttctggttctcatccactcttcatagaactgttttataaaattactcagacactaggttcacattattactcgattatttttaagaatgctgttaaaagtcaggaacctttatttatttattttcttaattaaaaccctcatacagaaaatgctcaatgaacatattctagttcttaacccccagatgaagaaataaaataatgccagtgcattagaattatagcaagcaagcccccaaccccaaccccaatccaaccttcttccccaaaggtaatctctatcttgatttctatcagtgtttttgtttcattttgcctgtttttatgctgtataaaatatcatgatattgtatatattcttttgtgactggcctttttattcaaacttaagttggtgagattgattcacaatgtcgtttataactttagtttgttgatttttactgctgtataatatctactccatgactgtgaatatatatgacaatttacttaccactttactcttgatgggtgtttaggtgtgtccagttttgatcatgtttaatagtgtttttattattgctgtttttcctatgcatagggaaaactttatatgccattaatatgccataggataacatataaatatagtcaaatttaatactcaatattgaacagttttccagggtgattgtgccaatgtatagtcctactggtactgtatgagagtgctggtcactccaattccttgtccatacttggtgtccacagttttgtaattttagctatgccactgggtatatagtttcagttttaattaaaatttttcttgaagagtcctataactgaaataaattgaactcatccttaacttatttctggatttatttcttacatttgtttaggattttagtctctatgtttacgaatgagattagtttgtaattttcctatcttgaaattctcttattagagttggcgccaagatatacccacataatgagttattcagtattttctcttttctggaagaacgtggtgttatttcttccttaaagttttgcaacagtttactgataaaattgtctgtgcctgcaggtgtgtgtgtggggcaaggggaggttttaaattatgggttagatttgttaaaaattgttttatgactattcaaatactctatttacttatatgtcagttgtgtatgtttggctagtcccttgtatctaaattttccatttttatttttataatggagaatcctattatatttgaagtctcctttaatattcctgcattatttgtttgaatttactgaacctctttgttctgcatattttttctatttaaataatttctgcagttacctttttaaaaaatttccttcagtttaacttttatttctttttctaagttttgaagtggttggttgcttattgattttgttttcctttatatattgaaaactgtagtttttcctctcagcatattatgctttagtttttcccagttttattatcatccaaataaaataattttttgttttccatttgattccctttttgacttatgagtgtaatacttgtcaaacccacagatgttatctgtttattatttattatgaatttctggattaattccactgggggtataggacatactcagattttaatacttggaaatttgttgagactcctctggtcaattatcctcaaggatttgtatgtacttgaagtcatgtgattaagtttttgttgcttgtgtggcatttactgagggaaatatgttaaaatctcccagcatgtctgtttgtctatttgacttttattttaaacatatttcattttcctttgtatctaatagtacttttttatggtgctaatttaactacactggttttcttttggttagtgtttgcatagtatatctctcattcatttcaaactttctatatctttatatttaaaatttcttttaagcagcatgttttagtccagactgaaaatacttgtcttctaaaattgtggtattaattcacttccatttaatatgattacagctacatttggatttcaaactaccatcatattttttagttctgaatggtaggtagtggcttaaaaagttctcaaagtcatctttttcctacttgaatatgttaagtatgtttattttaatatctgcattggatagcacattatttgtattacctgtaggttcatctgtgtcatcttgatttttgtcagattgtcttgtctcttcacatgcctagtcattttttaattgcatgtcagatgttctatgttaaaattctcagaaacaatgtgaggcctagtatgttgtttgaaattaacaagtcatttttcaaatgacagggagcattgctatacagtattgctatactggatcaatttaatcaaaattctgggattgaaatgattcaagtgtggtcttttatgttatctaggaatattttatgcttccttttatttctgtgttataacaccttggagtctcaatcctacatagagtgttttgatataaccccctctttggtgagttctggacttcaatttatgtcctctaagatttagtagattgtcaaacctttgtttagcctctcagctaccttttctgaaatcactaaactttccaagggtcaatgtgataccaaattttaggcttactcctctgaattccttcttatcctgtatcttatccctttaatactttcttgtatgtttgggatattttgggcacttaggatctttagcttgatgtctttcatcagttttagttgcctttaaaaatatttgtagagcttttttagttctttctacaagtgttgattctttttacctgatacgccattatatgaagtacaatttcctcttttaacaaactctaaaattttttttagtttcttgaagttctttgctttatgttggttaattttatattgcttctccttgtatagatgcaacatagtcttgtatatttctaaagattcccattatttttaaattgcttataggttcttttatttcttgaattatctgtatttcatctattattgatttccctcctgtttattttgatattgctttttatgttgcttactttccccacaaagtccttcactgtgatccttcattatatattcattattaagaaagaggaaatacattagagagtctgatttctgtggaggtgggtggggtttgtgaattttgcagctttcatttataattttttaaagagcagaatgtaaacaatacaaatgcactctcttttttctgggctgctagtttctgctgagtgggaataggagcaggatctactcttttggaatcagaatctgaataactcttcatacattcagatctgagtattagccgttgccttttcattccttgattttttttgagactaaagtctgtattcttctgtctttatttctttcccaaagtacaataatttatagctgtgtctgatcttcttaatcagttactaagcttctacccctttccacttctatcttttgtaaatttgttaaaaatcccttatccagtgatggactctctttctttttctaatgtggagatatatctatttagatgttatattaattttctgttgctgccatcaggaactaacataaatttagcaggttaaaacaacacaatttattattttacagttttgtgatctggaaattcagtaaggatctcaccagactaaaatcaaagtattagtggggcacattggctatgttctttgctggaggctataagggagaaatcagcttgttgctcatgcaagttggtggcagcattcaattctttgtctaagaatgagctactgtgttcttaacgatgaccactcgcagcttcttgaggttactcaccttccttgtcccgtgacctctatttcttttatgtatttatttatttagagacagggtttcactctcttgcccaggctagagtgcagtggcgtgatttcagctcagtgcaacctctgcctcccaggctcaagccatcctcctgcctcagtctcccaagtagctgggattacaagcatgcaccaccacacctggctaatttttgtatttttaatggagatgagttttgctgtgttgcccaggctggtttcaaactccttaactcaagtgatctgtccacctgggcctcccaaagttctaggattacaggcatgagccactgtgcctggccacagccctttttctttatcttcaaagccagtaatattgggtagacgtcctctcgtacttcaaattgcttctgtctctttatcattgtacatctctgaccgactcctctgacttcctctcctacttttaaggacaatgtgattaccttgggctcacccaaataatccaggataatctcctattttaaatttagctaattaaagcattaattccatctgcaatcttaattcccttttgccatgtagtgtaacacattcaacgaagtaagactaggggggtgaaaatcatgtggtcaaaaattctgcctgccacaatctgtggtctgcccactgccatgcactgaatgctccttcttacctttctgaagatcgtctgtctgtttcagggaaaccttattcttctcaatctccttatttctaccatttataatttccctccctcttttataaaatatctattcattcttatgcttgactattttctctttctctaagcactcttattttttcaaagagcttcaattactgtctatacaccagtgactttcaaatctgttatctgcccacaagacccatctgtaaaactacctacttggcattcctgtttggatgtttcacagtcaaataaactttaataaggccaaaatatctcaccgtcttcttccctactcacacattccaaacttactgatctttcctctttgttctctgtcagttaatggactcacattcccagtcagttatacagaccagaaatgtggtaatcatgtttgatatttccctctccctcataccctacctctatcagtcattgacctattaatgcttcctatcaactatcctttgaatgtttccagtttatctcactatcatatatactggtctccatctcactccaggcctctgctgctttctctgcctgaaacaactcttgttgtttttcctgctttcttgcctaagttatacttatcttttagacctctgataaatgtcactttcttggaaaagctctccacaaatcccagggctgtcataaaattctatacttgccatttatattaccgtaactataaatgattgataaattatgtaacttcataaaataaacattttattgttgaaaattttagatttacagaaaagttgccaagatattacagtccccatatattactcattctttttgccttatgtgttgttaatatctcatatcactatattacgtttattacaaccagagaacccacgttggcacattactgttgcccaaactccacagtttatttggattttaatagttttccccttgtgtcctcttcctgttccggtattccatctggtatacaatattgcatttggccatcatatatatccttgccttcctctggtccatgccattttctcagactttgtttttgaggaccttgaaaatcttgagtagtactactcagatattttataaaattccatctgttgggttatatctgtttttttcttcatggttagacttaggttataggtgttcagagaaagatcatggaggtgaagtacctttccctcaaatgatgcagagggtacatatcaatatgacttatcgctggtgatgtgaactttgaccacttggctgaggtaatgtttgctagacttctttaaagttacttttttctccctttttatactccactctttagaagcaagtcactaagcacaactcataaacaagggggtgaaatttaaactcctccttgagaagagggtatctacataaatcatttagaattcttctgtatgggagatttatctcttctccatttatttatttaaccacttacttagatcagtgtggacacatggatatttattttattctttgtgttacaattcaatactactttattttgttgctcaaattgttatagctttaaccattggaaggtgtaattttttttttttaagagaggggtcctgctgtgttgcccaggctggaatgcagtggctattcattcacaagtgtgatcatagtgtaatacagccttgaactcctgggctcaagtgaatctccttcctcagtctccctagtggctagactacaggcacgtgtctcttggcccagcttaattttttaaatgtctcttttcctggatagaatgtaaactacatgagtatgggcttcaggtcttctaaaattttagtgagaagcctggcacctggtaaaaatcaatttgtattttgtgcaaaaataaattcatgaatgaatgggatctgtaaagatgagaaagtatcattgtgcttatttaatgttgaatgattcctgtgttgtcttccatttctaagtgccagatatttctttatattctctgagcctccagactgtggtataagtacaaaccaagagacacaaaaatcaatttaaaagataaatctctgtattgtcagccttgagtttagatggatgacatcattgttaccttggtcatctgtctcacttcagacttttattcatgcatcttactcatcctgccatttctctaagtcttataatcacctactctacattgattcagacccacatctaattgtggtggcctctgggttttcccacagatagccaccaggtttttatgatttctagttttactccattggccagtgtgactaaatcaaacctgtgggaaggagctaagatttttttattgtggacctatgtatgtgtatgtgattttttaaaacttttggctgtgtgctgaaagaagaattgtgttaacttatttttaatattctgctactttccctttgggaaagaaaagtacattttcatggtcaaatatgggaactttatattattattcaccatcaattatagatctcataaatcaaaaagcagtattaaatgtcatatttgtaaatgctatttctgggaaataccagatctagtgttattttgggaaactgtgggttgaccttgcaaaactcacattaacgagaaaaaaaagcacattttaaatggtgacacatctaacagggagcttaacagagcaagagaaagtgtgtaggtgttcagtagtaacaacctaatggtaccacattgtatttcatgaatgggagcaattcacaaagttcccacaaataggacctcatgcaagaacacaactgtatagtggttttctctatccttattctatcaacattttatgagtccctactaagtagcagggaggatcctagttattgtgaaaataaaaatgagtgagttacaattccttcctgcatgtagctcagcttagcaggggaactcagatcttataggtaaatcattcatattatatattatagaaacaacgaatcataggttagatcaaccaggagagtaaaatcatgtcacccagcttgacgcccagatgtgttttcttgcatttaataagccagtagcagagaggaatataaggagctatgtcagaaacttaatggaggtgatctctgtgcatagcttattaataacgattttccaaatgttccatagtttctaagacaagtatatatatttttttaatttaagaaacagggccaggcatggtggctctcacttgtaattccagtgctttgggtggccaaggtaggaggaccccttgaggccaggagttcgagaccctgtctttaccaaataaataaataagccaggtgtggtggtgcatgcctgtagttctagctactcaggaggctcaggcaggaggatcagttgagcccacaagtttgaggctgcagtgagctatggttgcaccactgtactccaacctgggtgacagagggagacccccaactcttaaaaaaaaaaagaagccaaaccaaaaagccagttgttttaagctactataatctctaatttgtaacgataatttcagtatttccttgtgtttatttccatacgcttagccacttgtggagttttctttttgatggtattaaaataaaattctttcttttaaatcattaaaatgcagaggtaaaagaatctttcactacagacattagacagcctatgtgagaatctcttaaggcaggagttggcaaacgttttctataaagagccagatagcagtaaatattttgggctttgcaggctatatggcctctgctacaaggatttctctgctttttagcaggaaaaaaaccatagataatatgtaaataaatgggcgtggccatattccagtaatacattatttagaagaataggcggaaggttgaatttgccatagtttgccccacccctgacttggaggattcattaaaaatgcaaagaccaagttcttacaccttcctgaattagatttcagagagataagcctttggaatctgtgtgcttaaccagttgcatatattattaatattattattattacttatactcaagtttgtgaactttcattttatttatatactaggatatctgagtcctgaatttgtctctacagtattgctaggggatttttcatttagcttgaatagttactttgaacttttttttttattttgaactatatttatggagtacacctttatcagatggaacctctgtttcaaataattgaccgagaaaatatgaagggtaagtttctgttgagttaaagttcaaaaatggaaatgctgaaagaacaaggacctttttcctcctctttattgctatatttctagcacttggaactataaccggcacagggcaggtgttttgagaaatatttgtgtaatgaatgaatacacatttgtattacttcactctcggcatacagtgatggcctgaatccaaatggctgcactgtccctgtatttgatatctgggtaatcaagtcctagccatagcctttctgcttttacacaataccttttagtttttatccaatattccacctgtttgcattaattttggggttatgaatgctgcccttaattgtgctgtttcaacattcatggttccaaagcaacatctataagtatgaatgattatattagctaaggatcttttgactataatcaatgaaaatccatatggtcaacttaaacaaaaaaggtatctattaggaaaatgggttaggtgaaagctcagtatcaggggcctgctgaacttctctctggaatgctacccaacataactcagctcctaaccttatcctaactccaggcctgtgcacatgctgttctgtgtgccagtttttaattctgagagattgggattggcccagctaagggcaagtgcctgttgtttggtttaatttcttggctggtgggtcagggggaccattatgtaaccatccttgtggagagaaaatcagagattactaccagaaggatgtgggagaagagatgagagatgctaggaagatgcaactagtttagatatgttgattttggtgcctttaagaaaaaaaaaactttgcaaataactatttgtgctctgatttgccaaagccctgttttaaattctgctattaatgcaaaccaggctgcagacctctgaggtccatgctgattcttctctccaggcctctggtctgctgtgaacagggctgttctctaattgttacagacttcctctaaacctgaagatttgatttggagccttgctttagctgcctttagctggaagatttgattttgagtcctgtttttgcttttagattatatttatttataatatctatccctctctacttccaagaaaagattgttaattccagatttaaaatcaaattccatgctaagaaatgacacagatcatcttcagactgctccctgtaatctactcatctctggttctgtccttgattagctgccacccaaacagagtggcccagcatggtcctaaatccaagccataggataaggatcctagaaagagaatggagttctttcccaatttatgtccccatctcccacatgcgcaacccccggaagctcagtctttgttcctttattgcagtctgcaactactgacaggttctgactgctgtctactccaaaagcatcatgtatacttctccccactgctttttgtgatacagttccactggcctgctttctgttacagacacacagaagtctattccctctgcgtgaagcgggccttccttacgtatttacaagaccggctccttcatgtttttcagatctcaggtcaagtgtctccaacttagcaagagatgccttctcaaccaccctttctaaatacatagagcatgcctcctgagtcactctgtatccccttaccctgttttattttaatgttgcaatgatccctatgtagaatgtcacttctttgtatacttgtttatcgctttgttttcctgctagagtgtatgccccaggagggcagagatcttgtctctggtttatcccagttgtttagaacagcacctgatgtactgggtgttcacttgtaaaaatgaatgaattaaggccacttagcaatttctaaatcacctttgatatacaacaatccatatgcacagcaatccagatagactcacctgtctgggatatgtcaaagccacggagaagaaaactcagcaatcagcatttttcagactgtggggagctgagatcactggccttgctgaatctctggtcccagaaacaaatacagacagggatcgccagcattacttaacacccattcaaaaaaaggcattggggatttgcagcaacttttatacccatgttcttttgtcacccttctcagtatctgtatcagcatgtttgtagggttcagcagagaattttgtcaggttaggaagaagtaacatatggtagttgtgatgaaaccttagcaccaggcatgcctctaacattaactcagaggacttgttttcgattctttcttttatgaaacccagcctttctattttctgctaaatcaacagttcctatatacacatcagctttacaagtctctaggagacaatatttcttttccactaatatgtgtattcacagcccaggtgcacatgtgcatggatgcacagacaagggactgcattttaagaagttttggcagaagccaagccatagcataactcattaagacaacctatgacaatataagaagagattattttggaaattcttaaggtaaagataaaagacaaaacatacatcgagtggtctttagcaaccctgagttctttcctcagtagctcttcttggatagcacacttaagttttcatatcaaatagtaatacagctcacctctcactgactagagccttgttatgttttccgtaaagcttcatgctgatggatcaacctgttggtgaaatggtgttaaatggtcttaaaatagttcagaaatcaaacccttcaaatctttgggtaaagtctaagaggagcattatattagctgtacagtaaataatgctataaaaagactcttgtatgagttaatggtgttccacacacatcacttagggtgcaggaatgaaacaacttgttcttaacttgccaagcccttgtacttttcagcttcttatctatgttcttggaaatcatcaaagaagaaatggaggaaggggatagcatggtaacatttctctgaggaaggctatttctttccgtccaatgctgattgtgagccttggtaatctctctcaacttttctatgtgcatacatatatgcattttatggaagctaaattaaattacatttaaaaacaacaatgtggcaaaatgttaataatgggtgaatctatgtagagggtatatggagttcttagtactattcttgtacctatactgtaagtttttagttgtctagaaaaatgtttaacaaaatatcagcagcatccaaggtggtcacacttgtgcttttgcatgtcaggtatccatctatagctgcccctgtggcatgtgttttttcctgctcgactctagccacaataatcactagggtaggctgagctgaactgatgaaatcagatatccagggaaacaaagcaatcaaattttaatatatttctttatttgtacatattttattatctttgaactatagttttttcctttgggggagtaaggcaggtttattaccaaattttaagaagattttatgttctcagagcatttaaagcatgtttgaaatagataatgattattttatgtgtttatcttgagctgagattcatattctatggtttcagggtattagtgaactacttcttaataaacacagcatcaaacctgaaagtcagagacacaaaaacagtgaaatttaaaaccgtctccatagcaagaatctggaaaatctagaggagaaaaagtgaatgaataaggtagtatggaaggaagaaagagaggagaggagaagggtggaaaggggaggggagcaaaaagcaagaaagaaaggaaagaaggaatggtcaaaaggaaagagaaatctataaagacaccttgtatggatgttgctgatgtcacttattgggaagcataaaatgtaattgaaagatagtcacagtaagtgttaatagaattttaaactaaagttcattataggctgtggatttaccctgtgggttttgtggcagctcaggcttcaagcaaggcctgctgtagtgtcatggtcaggaggaatcctttgcctaacagagctcggaaggatcttgtggtggtcagtgaccagaccttgatcttttcacccagggaatccactgccttagtaacaaatctctgcaaatgggacaagagccatggactcttctgacccctgatcccacacaaagtgccatgtcaccaaatattctgtttcttgaactagtagggaattgttctgtgtataaagtgattaagttaaattctttgagtcacatttttacagagatttaagagttaattttatagagggtgccaagcttcttagaagcaagaatatggataaatatttttggttaccatttcccctgtcccgggagatatcttgctatcattatcagaaattacttttattattgtagaaagaagttcattctgtagccccaaacaaggcaaaggtggcaattggacaataaatcagtactttgtcaacatggagatgcatttttttctaattttactaacactgtagccagtcactatgccgccccagcccatgcagctgcataattatacatcagatctccaaaatgaattagtttatttttaaaacagctaattgccttagtggagtcatgttttaccagaagcacaaaagggctttgttcactgcagggaaattttcttctggaatgactgtgttaggctctagcttctgtaaatgtcagtcataaacagcaaaatatcagcaaaatccactaaaatcactaataatccagaacatctcaatgcgacttcagcattatttgctctgcatgtagctctatgtgattttaagattaaaatggcatagttaggtatgttctgtggtacaaccatatgtgactttttatgtgtgctttctgtagcccagtttagatatgtctcttgaaacccaactatgtgtttataaggcagacctcttattgcatgtttggtctccattagggatgacaagccaatttttggaaatcaagactcctctctattatagtcttaaacttcaatttttacattttgtttttggatgctattatatttaaatagaaatagcaggtgtaatgtttatgctatgttactctgcagggatagtgggctcagaaaacactgattaaggataagttcccacagtgtggcatcaccttgacaaattcacatcagtaatgcccacaaagactagtagattcaatcctaatgacaaatgaatactcacaataaaaagtatttccccaagggacaatatcctcatgacttaatgaccaacaagttgtaagaaaccagattataattagatgtatcatggcagaatattgactcaaacccatacttattagttacatggtttgagtgtttaatagcatgaggctaagacggctgactagatctgcctctaggggacttaaatgtggcaggaccatcacagacagcctcagatgtgaccccaaacccaacatgacgtaagtttctggactttctctttaaactttaaggcctgaagcattagtatttcagacttcataatgtataagaaaaaagccaaatgattatcatacagttaattttaaaagtccaattaaatatcttatttcttcccttaatatttctccctagaaggcaataaacttatctgtatatctctgtttcaattttttcttcgttctctgtccacacaggtcccaaatagattttattattttgaacaactaagttctggctccagttttgtattcctacctagaaaagcaaagcctgcagttagctaaaccctttctattgtttgcaaagttctgctttttaagtttgccccctggaggtctcatgttccatgccaaataggttttcaaagtatttacctaataattcctaggaaaacattctgctcctaagaaaaataatacttaccacttacaaatataggaattcacatgcctttggtactgaacaccctctcctcaaagtagactttaggtgggcattgacaatgttcaccttgacaatgttcacctttgtgctctgcattttctctgactccaaagctaacacataccccttctgatgaatccttcattaaacagattaaagtaattaattatattatagtcaactatgactaatctgcaatctactatatattttctaatttgagttagctcccccaaaacatgaatattaggacaataataatagcctttgagaccttacttggtccccactaagtcacagtttaatccagcgtgtcttaatttctaagcaaaggctgacaaacagggtgatcagttatgtgtgcgtgcgtgcgtgcatgcgtgtgtgtgtgtgtgaaacaaatacacacaggtgtatttatttcaggaaccaaaagactgcatttacaaaatatatttgagatggagatagttattaaattaaggccaaattgtttccatatggtgaaaatacttctttactagtaaaagatatttttataatttaagaggtttaagatggtttcaaaattcatttctcatcacatttccagcattcatgagcctttgaaacttaaagccagagaggagcttatcatttgacaaattacataagagttccagaatttaatgttatgtcgattcttaaaattggccattattcacaaattatatttatcacatgcgttcatgaaaatcaagagaactttagaataattatatatattcctttatctaatgttaacgactcacagcctgtaactaccatctgccctttctgccaatggtgtatttattaatatattttaataacaattctaatagttttcattttagcttaaaatgtgtttgcctaccacaactatacctgcatttttctatgcttgcttttcacactagaaaacaaagaccagtcaatactttaattgcccaagggttgtaaacagacatgaatgattccttaaagcaccaatcacctttaggaaaaaacaaacaaacaaaaaaaactttttttttttttgagatggagtcttgctctgtcgcccaggctggagtgcagtggcaggatctgggctcactgcaagctccgcctcccgggttcacgccgttttcctgcctcagcctcccgagtagctgggactacaggcgcccgccaccatgccccggtaatattttgtatttttagtagagatggggtttcaccgtgttagccaggatggtcttgatctcctgacctcgggatccgcctgcctcggcctcccaaagtgctgggattacaggcgtgagccgccacgccgggccaaaatactgtacttttaagtgcagtttatgcattttctaattctgtgctgcactctcaggatgatgggctgcgcattattagctcattccttttatgttatattacttagtttgaaaatcaacttttatttcagatgccatagtaatttctcactgttgataacagaattacaatgagaaaaccttgaaaagaatacatttagtttaaattaaatagaaaagaaaagaggaagataaatttagccaagattcaatttaggattgtaccagaatatttagttcccttacaaaatacaaagtattgctacttcaaatgaaaatttcttgagaaactctagccctcattaaatgaaatgtttgtaacaaaataaactttcactatcaatgtatcagagtccttattactcagcattcttaccaatacttggtattgttagactcaatttttgtctgtctgctgggtttaaaatggtgtctcattttggcttaattttcaattttctgattactaatgtgctgtaacatatttcatatgtggattggacattagagtttcttttccatcacttgcctattttcttttgccaactttattattgggttgtcttttcttattttttaaccattattaatatatattctgaatactcatttttgattcattaaattcactgtaaacgttttctctcaatctgtcattaatacatttccctttttaaaagtgtctttgcacaaaattatattattatatcatgtttatcaatctttttctttatgatttgtgttcttttatgtctcatttaaatcaattctttacctgagaatttaaatgtattctttgacattttttcttgtaaaacttttcaagtttgctttttgtatatatgtttaatctacttggaattgattttctgagtgggagtgtacatgtatatgtgtatgtgtagtttgatacaaaaaataagagtttaacatagagtagcaattatcttagcaccagttattgaaaatcttcccttctctgtagtgctagtattgatatatgtaaagcttccacatatgtgggacaatattccacatatgtgggcctaattgtcgttggtctattctgttctcttacctagttgtctatatttgaaccaataatgtattctcttttgtatagcttaacaaataactcctgaaatctgataaggcacataccctcattttaagttccttcaaaattatgacttttcttggaattttgctatttcatgtaaatatagaagtagcttgtcaagttaagaataatattaacactaaatattgatttttttctatccatggacaaaatgtatctccctatttttttctttattgtcctttatctattacttcttcaattcaggacactttacttagtttaactatcgctcaagactattttattaacattattttaatattatgtaatatggtaatggtttattatattacataatattgaagtgtgagagtaggcctgtgtgtgccaacactcagttatcctagattgcaatgctaagagaggtctaaaatctgctaattttagcttttcttctttctcctttattttataaattccactctgtcttttttttttttttttttctggaagattgcctgtttctagcagaaccttttcctcctttctatttttttttccctagtctgctgccaacgaactttttagaatttttttctgagataaaagtaaatttattttgagtatgaggtttacaacatactaattaattagctactagttgttgattaaatactgtgcaccagtgtttgtattagacattctaggttttcccagcaacactactattagggatagatggtaatcaccagtacatagataaaaccgaggataacatgccccagattatgaaattagagtgctgtgtggtcaagattgagtccgaatctatgttttttctcctagcaccaccctgcctctaacacataacaatattttaacactgaagtgtaatcagagacaatgtgctgtacaattctaaaaccagacaacctgattctgaggcaggatgggcacccttccctaactttggggccatagagcaactgctgtgccagaaagtttgtagggagggagagtggttaggtaagtagaagagacagagatacctgggggatagagctgcaggaggctttcaaaggtggttgtagtgagctgaataaagcatttccagtaggtcagagctgcagattgaggaaaggaaatagagttttaagatatttagtctgttctgctgcaacacgtgtttctataacaaaaattaaatgtgattggtacataggtgataatgagtataaagtgatgttggttcttaagtgatttttttctagtcatggggaaccagaagagtagaaatacaataataacttttagtaataaatgggaaagaaaaagccatcaactgggctgctacattgccaacaggaatcatttggagtatgtttaagaaattaaaaactagtatctgcatccagtgagttgcttatctcagttcctcgtgcccaaacttgttatgctgtaggctcatggcaggggacatttcctccaagcccacctaggctgcagccctgcagcagagctccagttctcccagcagtgcctcagtccccatcaccccgcttcactgtcctctctattgttttgtgcatttgtccatccactgtggcggcttctggccaagctgagctgctggttttttggagagggcaatccaacttttatccccacttaacaactgtaaatatcagtaataataataatattatatgataatgatagtgatgatggacatggtggtataattaccaaataacataggctttgaacagtttgcttataatcccatcatctcataaacttgttatttagagtacatatttaacagaatatgaattttctctggaacgcaattattgtgttattgctgcatacgtgtactgttacaggtctaatgtttccttcgtggtgttcaaaaattacaaataatggaccttacttacttagatattacttttgggttactcaaatggatattaactacaacaccactataaactgctgaacactatgggttatggttataagggttatacttggttctgtttactttgagtaccagggtatttttgtcttcagtagtcagattgtgtcaccccagtatccattataatacctaggaaatttattttcattctaggctttgaaaagatgataaaatgatgtaatgtgagttaatcaactgcagaatggcttactttcctatatagttaaagcaaaattatacatgacaaatgatgagttgtgatatgaatcttcagttcacccctcactgtggatctagtgtatacctttagcatatggagctaagtccaggctagattacttgccttgtgtagtctgaatgcttgaggttcagttctggatgggccacagtattgcatgaagacttttgtctggttgttacttcctcatgtccagatccttgtaattatttgcagaaaaatcattattagctgtgtctgtaatggcctgtgggtgactttatgtgccaagtcttcactaccagcattttcaaagggcttggtttccttccaagccattcatcaattgcctatcgccacatcatatatgccttgaggcatgatcattcagtcaggagcctctgtaactctgagtgtgctctgcactttctctgcaaaattaaggtgatggaaaagatcatattctgcttgttctggcaagaagggaagaggtctgaactgaaaacaggggcacaaccatggaccctcatgtgccctgtcacactgttaaagagtatccctggctgctgagcatagtggtgtgtacctgcaatttcagctgcttgagaggttgagacaggagaatcacttcagcctaggagtttgagaccagcctgggcaacatagtaagacctggactcaccaaaaaaaaaaaaaaaaaaaaaaaaaaaaaaaaaaaaattctccttggctgccacgtctcagggattttttttaaaaactattttccccttatgtggatattgtttgtatttttgtcttgatctcagttatcttccagcaataaatacttgagatgttattagagttatcaaatcttacaaatgattattacagaaggatagaaaattgtattgaaggattaaaacataaattaagaagaaaagtaactgagcaatgcccttatttattttttttcttagagaagcatcacacatttttaagacatttttttggaatcacagagcataacttttcttcctgggccatcgaatcaaagcattaccaagggagcattaacagctaggtgtgcctggctctacagctcatgggtgtcctgtccagtggcttgctgccctctctggtcatgcccactttgtgtgaacactgaaggcccttcttcccaggagccattggaagaactaacacttgtcaaagcaaatcatatttgttatctaaatatgaggaaacccttaaaaacagaacaaagtctaacgcattactctataagacagatttttttgaagtactgctctgaagtgtgactttttccactgctatattaagaattagcaaaagaaaaagatggtgaattatgcattatatagtatatgcattatatacagtaaattacgctttatatactacaaagaaagaagagagatgcagaaaataatatggaagctaatggataagaaatatgtgcttaagttggggcaagaaagtcaacttttgatttctgtgaaagaaaacaaaggcttcaatgagtattatgtaaatgggtgtctcaagaacaggtaatgattgctgaaatgagggagatatcatcttaagcaactagaaaggacatgtgcgaaagcattgatatacagacaggatacagtgattttgaagaacctaagtaaagatgagagcaaggttttcagaaaaagcagaataaaggaaaataaacccacagcagtgaattggaagaactttgaccagtaatctgtttgatagtggatgtgttttgaggattatttatgacctgtatcagtaggcattgttgttatgatcataggaaaatcctgggaaagagggtttttggaatgaagggtggccatgttgtctaatgtgtcttcttacccaggtcgccctatgttaagaagcttaattctagaaaattttaaattgcttctggatacacataagaacttctggcagaatttttctcatctggaaataaagtcatttaaaatttttacaaatcaagttctttctgttttttcatttatctcaaattttctaaaactgatgctacattggcaattctgttaaagttcaaaattaacaaattttattaccagaaaggcttatatcatgactgtctaaacattgtgttattggcacagattcaaaattcaaaattttgagtattattttaatctttctgttttctatcaactgatttgaatcacatacatttaaatgtctgaaggccaatatattctactatgtaatgatctacacagttttgagatgttacaataattcatgattcatttgaaagtgtaaaaaagggtactttagttttaccctaatggctaaatatttaaaatactgttatggggctgggcatggtggccactgtaagcccagcactttgggaggctgaggtgggaggattgcttgagccaaggagttcaagcctaggcaacaaagcaagaccttatctctcaaaaaaaaaaaaaaaaaaaaaattagccagtcatggtggtgtgtgcctgtagtcccagcgcttgaggggagaggatcccttgagcccaggaggttgagtttgcagtgagctatgattacactactgcactacacctgggtgacagagcaagatcctattaaaaaaaaaaaaagtaaatgtctataggtattgaaatacaaaggtagccccattatcatagaacttgataatcatgggttctcatttcttaacccccatattggtttaagtttttttgttcatgtaatgctataagcatgttttgagtgaagtgcatattttaaatgaaatcaaatgcctgaagtttttgaatattatgtctgctgagtgttttctccctagcttttgaaggggatagcattaacttatgtttgtggattccctgttaattagcccttagaaccatttagctcctagattttagtttcgtttaactaggcctcggtttttgaagtcaacacataattattcctaattgaaataatgaaaaagtattaaccaggcatggtgatgcatgcctatgtctcagctactctgaaatcacgtgagaagattgcttgagcctaggagtttgaggctttagtaaactatgattatgctattgcatggcagtctggatgacagagcaagaccccacctgtaaaaaaaaaaaaaaggaaaacgtaaaaaattttagttcatctagggttttgaatttaaaataactaaacttgggttccaaagggtcccttctgcttataagcaagtaccattgagaatttccttcagacatagccaaaataagacaacagtccctgcttcattacaaaaaacagattgttacagcttcaggtgaaataactaatgttagctgattgattcttaaatagactgtccctgccatctggagagaaaacattagttggggggaacacattgtttactgaagatattcctaggttcgaattaaatgacaaacacaggcgtaattcattgtacctaatgaaggctctgtatttcatgtgagtgttgttatcaagcttcgtttctcatattaaaatgtcagatttggctttataaaaagaatatagcaaatagcccagcatattccaccaccttcttgttcattatttccatatcttatttggcagttaggaatcattgaatcattgaatatgaatggtttgtttagcagcctacagagtgatattcatatgatgaaaatttccattctaacttttcatatttaatttatatatatttattatatatatttattttttctttaagaaacaaagcagactaatgatttttatgttctgttttatgatgtttatagctgatgttagttcggcaatacagaactcaattatcttagttcagaatacagaattctaagtagtccttcaatcatttagttctaatttatgtattaatattatattataatcataatgactactgtatattgagtgctattatgttatcataatgctaggaactttatatttactgtttctaaatattgaagctatactgaaaggcagatgttaatatccccatttataacatgagagaattgtgactcagaaaggctaagtaacgtatccaagttgtacagtcctgcataataagtggcagagacaaaattcatatcaaattctgtcttaatccaggcctcttatccatacaataagccacattatttgaaatgttattgtcttagtctgttttgtgttgctgtaatagaataccacagactgggcaatttataaagaaaagaaatttatttacagttctggaggctgggaaatccaagagcatggtaagggcatcttgtgtggccttcttatttcatcatcccgtggtggaaggcagaagggcaagagagcatgagaaagcaagagatggctagatttgcttttataacaaacccatttatgataatgacattaatccattcctgaaggacctaatcacctcctaaaggtctcacttctcaacactgttgcattgggaattaagtttccaacatatgaactttgatggcaaactataccagttatatagttctgtttcataaaaaagagatgccattattctcatgaatcaaatttaaattaatatctgaagccaaagtttccacattttccagaatatatctctctgatctagaaagtatatgatcataaggcccttccttcaaaaggcttagaccatgtaggatctctttaaagctgaaaagacagccttcaactcgatgacaatgtaaggtggaacttctttttattagagctttgatgttctcagagtgtctcatcaatgtgttctgtagaaaaactgtaatagaagccagtatggccgttagacagaaccagggagacccttaagagcatagaaacaattgttaaaattattttcagtaaacatagtttcagtatagaaatggaaatgttttaagtaaattctctggaatcttgaatatctaattcctgtgtttaattataggaaaataaagcataatataatttataatctccatgttttatattgataatatgaaacatgtttgggtataatttcgtccagaaaaaatattagatttgggaagggtggtaggtagaatggggaatgataatgcagaagatggtcaaaattgtgtgcctgacatttatttgtgaaaataagtatgaatggaagtgtttagttatcaaatgttttatctacatttctgtagattcatatgtatctattcaaccaacatgtggctttgccaaggagatcatctttggagagtgttttgggggatgaaaaggatttactgcttttagctccagagaatatggtgcaccagcaagggcttctatctcccttctgtgagctcaccaaatgcagagacttttatattggatataaggaaaaagatacagaagtaggctgcttataaaagagagtgatgcctaaaataaaggcattgaaaagttgaaaataaagggaaagaaaaatatctaccaggcaaatgtgaataaaaagaaagtctgttgtagtaatcttgaggcaaaagtcatcataagggacaaagaaggacattatatactggtaaaatgaaaaagaatttcccaaatgaaaaagagtgaatacaagaacatcatgttcagagacatggaaaaatgaaaaatttgggtaatatccaggaattgtgtctgttgcatgatgtttgcaaaagaaagttaggggttgaactcctaggtcaggtggttgtcaaaacttgaatggccttagagtgtgtttgcctctgttcttggcactgaaataagagaagtcctgaagtagagaagattccataaccataggatgtataatataaacttagtgatatggccagttgtaaatgtttgtatttagttatatgccattgctataaatacttttgatctgttgaaacataagtaaaatatgttttaggtacttgctatttcttaaattcaatagttcacacccaattagatcgaattatgaagtcagaattgaattgcaacattaaccaaaagttgttgctattttcagaggctagctttctagaatcctcttgatttaaattggttatagatcatggtgtggtatgccacgtatcaacttgacttttgtagcaagaaatgatgtaaaaagctctgggttgacttttggtatctgctacaattatgttagcaagtagtaacttagtcttgtcacagctctcaaatgtggtatatattcagatgctacacatgacagaatttttggtgttcagaatttccaagttgataaatattaaatgtgcagctacataagaagcagacttattttgtggaataaaataaacttttgattcataccaagtagtgaagatcagaatgctaatccttaactggacttctagaatttttttattttcatagtcctgtagctaaaaatagtcttttcttgaaacagagctttccattaagtttctgatcctgtgaacaccttgtatgtacatagcttagtcaacataggatgggttagtcagtgttaacttgcatttcaaagtagacactgttaaataaagaaaatagtgcttcattattcagcatgaaccattacgtgtcacttaaaggaaaagcaaggttttctagttgatatgtactgatacattcaggcatatgtagtacatatactaatgcaaaatgatgttaagttgcttagttatcttatatgaaacattagttttagggtcacagaaatgctgtttatacgaagtataaaaattgtgttataagtttctgtagtgacctttgaagggaggcaaagttgggtctgaagctgtaatatatttcttctagaattttgagcgcaaatggtgtattcagtgaaattcatgagttaaagatagagcatgaagacattagccaatgcagcttataaccagagttttctggaagctctgtcatgactacaaggttactagtagtacaaggttcattactgtaaagcagagttacaaacacatttttatattttcttagtgctgatatctgctataaatgcctcacaagaaagatattttaatactttgttcattcaaattgtactagataatgatggtcacattgagatcatttatgctacagtctgatgccaagtctttttcactggttggtctatgttgtgggacaagaacaaggcaaaggaaatgcaaaaagtgaaagtgcaattaaactgcacttgctttcaatgagattctttattcagttatatacttagcttttaattatggtttatttttgttattaaattaatattttaataagaaactatataaaatgaataacaatgaaatattagaggttgaatagtatgttagtgatttactcaagatcagtagtcacttaataggttcatctgaagaaggaatcatttattcattgcagaaatatttattgagtgacatactatgtgccagacattatgctaagctctggtaatacaggagaaagcaaaatgaactattttttcaagttgatgcatgaaactttttataactctgagtaaataattcaacatttaatcaattatataactttctttagaatttatacagtttcttagaaaaacaaatgagtaacagcttttcaacattttaataatcatgaattaaaggtccataggaggatatttttaataatcagttatagtaatattagctagtatttattgaatacctatttgccaggtattgtataattctctatcatccttataacaatcctgagaaatttattattttgaatccatgcttataaattaaaatttagggaagacttgaagaaaatttagttacagagtttcttatcaaactgtatagtaatcaccttgattgtattgcttctaaaactgaaaattccatgaaagtagggcctgtctcattcttgtatacatttatatcttcagggcttgcactgtggctgtgaaatagttgatattcaatatatgaaataactcactttcatagaaaaaataaacttcccttgattctatcaaaagactattaagttttccttatctctaattacaggactgcacagggccatattgatttctcctcctgtgctggctgccttgagtgctgcagagaggggctgatgtgcaactggaaaacactcagaaaaaaatagaacctggaacaaaatggctgagcagggaaaagctgtgcacacatgcccatcatcttaagagtacaatgctgctctcattcgcaagctagaggatccctttcttagcaatccaccttagtctttcatactccgaatattgatagccttgttcttacctagccttacctagtctaattattttcatttttaaaaattgttctctaaaaatgttggctaatttgaaatcacaccaaaagatactttattcttttatatttttgctgtgtaactcctgcttttgaaaggatgatctcatcttatggttctcaaactttattgtgcatcagaattacttggagggctgattaaaatacagattccttccagagattctgacttactcgttctggggtaggaaccaataaattgcacttctagcaagttcccaggtgattttgatcctctgtaatcctctaaaaatagaataaatcttggctcaacacatcccatttgaagggaagagttattttcaatcactgcaaggccaatgattctaaagtttttgttgtcgttgatttgttttgctttcaaatataacagtctccctgaaatttcaatgccaacgtgatttctcagaccctttacctgctgtaaaatcttgcgtcagatgaggaagattttctcagaagaccatttgttatctaattaggctttctaagtggggagaaatcacttgttaattgagtatcccttattcacatagaattgatgatgttcctctaagaaatagaaaattcagataaataaggtcttgagttggaacaaaaattagtacactgtactttcccctccatcctattccttggaggtctaagggaatcaagctcactgactgcaggcaaatgcatatagttttattgctttaacaatagtttgaggaatgtgaggttgggagaagaggtaacatcaatgagtgagtgagtgagtgagtgagtgagtgagtggaggagcagcagttattggtgagtaatttgcagcatactacaattgtagagcacaaattcggtatttgaggtaattaagttttaaatcttacttcatttacattccagaatcatagggtttgttaatacatgaaaagtctctgcttgattacagatgaactgatgatatatcattgtggtagaataaattgggttacattacctcctttgcttgtttccagttatcaactgagattgattttagaagaaagcctattataatccagaaaaatacaacttgaactccataatctcaagtgttgaaatcccaaaagatgaaaatataattctgaaagaaataataaaacattctttatatttatttacattttaaaagggggtttatttgagaaaaattaaaacaaaacaatacactgtacacgataaaataaataatggcacatatttttacaagcaaaaacactcaggtatactagcaacagtcacaccagtataacagttatgatgcagacaaaccgtatttataaagaaataggtcaaaaatggaaatgtataaatgcatatcactgtggttgataattgtgtgcacccagctttatataactgtagtcatcttaaatttccggatgaagaagctaagctttttggcaagatggatcaaaaaattcagtgggtcaacaacacgcatatagttacccaaagaaccgagatcctgataaattttctttcacaagcgcagatgtacaaaatctttctttcatttattgaagaaatttcgacatgtttgggttcagaagtactgcttatatgcaaagtcaacgttgtgataatgcagttctcgtggaatcaaatttctgatgtccaaggcattcgaagagaagcctgccctagttctcagacagaaaccagttcacctcctgtgtctgttctatatgggtccccggcagatcggatggtgcctgctaacattgaggggagatcttcttcacctaatccactcaaactcacactaatgtcatctggaagcaccctcacagacacacccaaaaaatgctttaataggtttctaagtatttaatccagtgacatctcaaattgaatccacaggtccaccccttgtcaacttggctcccgtaagtctctccttaaccatacttaatttccaagtaaagactgtaacagccgcctaacatgatgcaactaacatgatgcaataatcctgcatacgaccaaaaactaatcgcttcaccagaatgcagctttcaagatttcatatttgagattttaatatttcgagattgttattttcaggattgtagacgtgagagattttagacctaagggatttagaccttagggattttgtatcttttcagatttcaacattcaggattatggcatgtgggattgtgtctttcaggattgtgatctaaatccattttagaaaaggtcattgtgagctagaggtctgaggatatttctggaaatattttggtgccatacaggttttttaatactttttttttgcttatatgtctgcatagaaagaaattggattatggtaactttgaaataacattttacattaggatttaattcccactttcatttactattaaattgagaacctgagatttttttggcccttgttactttttttacctttttctttgacctatgtgtatataacatataatatttggattagtttgcaataaatgcttacttaattgaatttgaatttgttacattgaaactttttaaactacccatctacctagcctgacatttgtattagcttgttatagttcttgtaatagaacatatatctttttcccccacattagtaaactgtagttttataaataccccaaaagaaactgagtcacatttctttactaacattactgagatgatgtgggaagaattaactcaacattcttaataatggaaatatggtaatcaatatagttgatggttgttttgatgatacttatttttcttctgagaaacaagtggggttttttgtaagtatccaatgtcttttcactctaaaatattttttcattatcaagagttaaataaaagagaagatggctgatggaaaaacatactgcaagaatgcagggatgaaacgtaaataaacctcatgttaaataatggtcaaaatgaagaagacacattatttacagtattttatgtggaatgccctttcctggatcctttaagaactaggataattactaactcagtcttctggagttttattctattttttattttttattataaaagctgagagatctttttttatcaattgttgtttgaaggtgtaatttaaacttaaaaagacaaaagatgcataggcatattgtatcaatatggtgattttgttatctcttttgtatattcatcataaatttttgtattctgttaaaaatcactctgaaacagacagtgggtccatttttcatcagtagatcatattaaattttatttggaatatctcagataatgatttgtatcattttggtaagggacaagatggtgagactggataatataaatgctagacctatatggttagttattaattacctgtatttccttaagctactgtctttaaagcctgactccaatagtgagtccttttgtaatcaagcctccttcgtttcctcatgagtgaatttcaatgattgtttttcttaatataagaagttcttgttctgatctcaccacaaaaaaaatggtaactagctgagatgatagatttgtagcttgattatggtaattatttcacaaggtataggtgtatcaaatcatcaaattgtacacctgaaatataaagaatcttgatttgtcaaatataccgcaatttaaaaaatgttctttacataaatgttttgtagaataaaaaaaaaaaaagttcttcaaaagaaatctcaaatctccaaatggaaacaggtaaaagtggagctcccctggttccacggagaaccttttttgaggaaacttaggcaactcgcaggtaccttatgtcatgagacagagtttgaaaactacaattgactatctctaaatttcctcccaggtctaaaatgtgatgatagttactacttcagtacatcatccttaaggaaaattattaggtccacactgtttctatcctttgaattttacacataaattttgtaatcaaaagtttatttgtaatatcagatggaatcagataattgctttttgttttttccactgacaggaacataagattttgttgtgtagcttaagtcaaacgcagtttggaatatatattttttaaaaattgtaacttacatatccaaatacaatttttcaagaagtagagtattcagtagaaattaatctgtgaaagaagaggaattcagcagtggcctatttgatgaatgatttaacgtgcttatttcttccctttcatcaaaactctgtgtccccttgtttgccccctctgacttcatactctggagttgaccaagatccctcttccatcggattgttctgggaattttgaaataatctgctttttcctctctttcccctgttgcttctgatgccttagaattacattttcctcgctgatttagtttagaaaagagaaaagagcttccatgactagtagattatcacttttgggtttgctcttggaagtgacaagatgctaggatccctctttggaatgtaaaatttatctcttatatagaaaggatataaatgtagcaccagagactataaaactctgatactatctactgtactgtatagctgaacgccacaatgtgtctggtaatctattgactatcataaatgctatttctacagaaaagttaggaggtccatatttcgggcaaccaatgtatagctgaatgcagaacagtcatagttgggtactaaccatatatatgatttatccatcaacaggtgcatatgctcagaaattctgtatccataagaaatcagactactttcttttccttttgcaagtaaattgaatttagcctgagaggctgaggggaaattttcacatataagccacggttttgtgttttgtgttttgttttgtttatagatatagtactaactggatggatgcgataaaattcataggtggtactaagatacaataggatttgtgaaatggacaattgtcttgcataaatagcaagtaaaaaatcaagcctgtccttcataaaaattttattctggggtgtgcttgttttccaaaagtacctctgctaaatctcctgttagtcctgaaactagaaggcagaaaagcttctagtgctacagccaactgcagtgtagcctgagaaacaggcaacaaaaatagaacaccaggattgctgtgcgtgggtgaggcagaaaccacattatgagcaaaagcttccagtattattttagaaccaatacagagctctgtacttctctcctctctcttccaaaaacacatactacaaaaataaaatgaaatgaaatgtatgtgcatttgccctcttagaattatgattcttaattttttttcttgccttcctttctttggaagcgaatcgccagtatggaaacacagtgtgtaaagcaagcttcgagagaggaaagagttaattggttttaaggccctgcgatagagaattatggttggaaagatagaggctggacagctgggtttgctggggtatttttaaatgcattaatgcaggctccaatcactcggccatgcttgacctatttttggctcaggccgaccattgttctatttctgtgcctgtgggccatgctgttgttgattcatatgcaaatggattatcactcgctttagccaacttgagctgagagagactgagaaagggggaagagaggcacagacacagataggagaagggcaccggctggagccacttgcaggactgagggtttttgcaacaaaaccctagcagcctgaagaactctaagccaggtttaattggtttctttttctcgtgggtagacttaataattttctacgtattctgacaaagaaataaccccgaagcacgttcctatttcccacctgcttgtagtttccgggataacctaaactccagagagctatagcatccactctgtcctttctgctttgcacacaggttggtaacatgggaaaagtgtccaggtctttttaaaagtggatgcccatttgagcagaaaggaaatcattgtcgaagttgatcctctgctgcttctcctcagggaggagggagaaccagcgagggtagctcctggggccggtgcactgagcagtgatgaatgtttcatgtagctgaagtaagagtgactggaatatgctgcagacaatttacgagagtgactcctgtttttcctcagatggggtggctggacgagagcagctcttggctcagcaaagaatgcacagtatgatcagctcaggtaagatcctctttcataactgagacgttttaggtttgaaagggggctggcttgggaaatgcagctaagaaaagcacctctcttaaggaaattgctgctttttcgtgttgatgttgctattttcttggtgcgtctgtagggtttaacttagatcccttccattactgtttctgtgcatattcagtctgcttagggacagcagcttctgaatgaaattgcaaactattgcttctgatgaaagatgagactgagataagtaaaatgtagttgggggtgttttgcctttactatgcaactagaaaaaggagctgtgtactgattgtaagcctattctaataggactttaaaaatcaggtaagttcatattggggcttcagtttaaactgcagccccgctagcctgacgattttatatttactctgtgcctacagaagcacatctatttatagacctaccttctaaaatgtgtttgccacagagttataaaggtagttttcttttttccattatgtggctttttctcatcagccccaaatgaaactgtttaggatgaaataaaattgttattagcagatgcttattttaattttcttcaaaaacatgtgggaagtctagcattgtcaggcagatgtgatggcataacacacatgtaaatgtgttaaaagcaggtgcagcgttttaaaggataataggaacagattctaatttctagtttctcaaggagatgagctggtgggagattgagcttgtcagccttgtcaatttatacttactaaatgaacatactctccaggcagtatcacttaacgtgtaattattgcctttcatatttatttcctatggctatttcctaaagctttgggaactctttgtttctgtcctcttctgaatgtttcaacctaaaattggcttaaagttctcacttagatcccacttcccatgtgggcttaatcgtaattatagatcaccgcctagatttccatgataagaatgccacataaagcagtgtttactttgtagagctaggtgtgaaagaaatattccacaggttggcatgatgtctgttttggtgttaatacaccttcccatatggggatctatgtttaaagctagttttctttaaaccttggttagttatgttaattttaagatccttctgttgacccaatcttttcatggaatcagaataaaatatcaattttgcataatttggtatttatacacttaagtgacaggaattatgttaatgaatagtgcctgcttaacaaaagcaaacctaccagaatttcagtacagtttattcttatagctgcaaagctgacaagggctccgggagggtttaacaggtatgtctctaatgggactggtcatttaacttagcattttattttttaaaatatggatgaaccctttgaaaataactattttagaaatcttttcagcactatgctttatccttttagtcctcacttctgtgttacaagtttgatattttttttcatatggtagaaacatacatgccttccaagtagcaagtgtctgctgaagctaaggctggctacaggtgtttgcaagctttgcttttttctccacatctttgataatcacatacagctttacacccatttcagtagagattgtcattttcctagcatttaatggtttgtgtacaaagcaacaagattttcagacagggaagtgcttcaggctgtccatgctttggccagttctacaagaagcaacatttaagcagcagctagctattaaatgaaaagtgatgtaggttaacatcaactcccaaaacctgtctggtataaatacataatcactaagttctatttatttttaaaatgtgaagcataaaaacaattacacccttcctgccatgccatatatttcatatatgttcttaaatttaattcacctagtctttattgtatacttcctgtgaggcactggctctcaaagttggactcaccagaagcactttacaaaatatgatacctagattccactcccagaatgcctggtttaattggtatggggaacagcctggggattgaggtttttaaaatctccccaccttaaccttcagcaaactgagattcactgctgtagggctagggaacagatggtgatgctggtgaaccactatcagtagggtttgtcctttgagctaactgctaaattaggggtatgtttgtcttaatttagctacaaatcttgttcagctcccttttggaccagtggtctggacgtgattcataggcttagaagcagagtctttggatttgaaagagagaaaggatgcctggcagcagtgcaaaggagtggagagagcactgttctaggagtcagacactctgtattctagcatgagctccactgctagccgattgtgtactgatttttttactcatcttcaaactgaagaataatgatgtcctcctgcttgcctcttagcattcttgtgaggttcagatgtatcaatatgtctttaaaacgtatactcactattagaattgttgtttttagtgaatgaacctaagatcttggttttcaatgccatgttctatcttgctgaacaagccacatgagttacattgtaggtcacatgggggaaatgattgtttgttttgataatcagtttgccttagttatcttataaatcaactatttattttgttaccttggtttgataagagttgagatctttcctatgcagactatcactataggtaagagtagggtgtgtatgtgtgtgtgtgtgtgtgtgtgttctctgaaatgtctcattatgtaataaaggcaaagaagttgcacagtatgtgattgaacagtgaaccccaatcgcagatttcatgagattatttttaaaacattggttatgttgtgtaatttctttagcaattgcattagagttcccatttgttgttctagttatattggatattatgcactaatattgatggtttttgtacagagctctttatatactattggaatacaagttttttttatggttgtatgtttttttgatattgactcggccaggctaaacatgtttggtagaaccaggttctataatattgtactaatatattttagtttaaagttctataatattaaatcttagaattcagtgtgagtgacacattttgtcaagtacatccctacttttgtggcttgtgtgggccagggtaagtgataactgtggcagaaagtgaagcatgtacaaatattgactcaggtcactctgcaggagctggcaggattaggggtgttctcccattgccaagcatgttgcttaacacgttgggcagcagagctgtccagacaatattggaacaattattatgaaggaatttcctagagtttgtacagaagtaatgtaagatatatttacaataaggaaagctcatattttggccatctattcttactttagggtataaaagaaaaacatttaaatcaaagtcctgaaattcttttatatatcttcacccttttttgaatccttttgttccttagtgtatggtgttgaggggaagggaacattttagattcagtagtcacgtcacttatgtctacttgaaaagcagaatctaattatgaaaatgtaagtctgtgaaatgttcctgtcatgtcaagaatcacttctggtattccccataattactgttttgccattctctaactcaggttatcttcacttgcaagtctgttatcaattgagatagatgataggtatcaatcagaaatataattataaatgggctcattgagaatggagacaagaatgagtatttcatatttctaaggatgacacaggaggcataattattgttatgtccgttaagtaagaaaatccaataaaaccccttggaagactgaaataaatccaaattctgaattcaaaaaatattctaaatgatgattttaattttggagatgagcaattttaaaatgtgcctcataatttctcactactgataaataatgaagtgagcccaaaatagcatgtcagccagcaaacataccttccatccctgtcacccaatatattcaacagtaactgagcaaagaaaatgatataacctaatgcaacatacctcagaggctaacagccaaggcaaaaatggatgcagaggttctttgatcataacagagagacctgtctcctgggctgtcttagaattttactggcaagttgaccagttcctgaggattctcactaagattcccaaatctgaagagaagaaaactgagtaggtatcctcaccattttgggttgttcttgttttctcttgtggctgagaaatagtagaaatgaaggcttcagagcagcgtactaaattgggagaaagatcgatccatagctctttggaatgacgtacctttcaccaactaaacttagagattctgccaagaagaaaaacatcaactcattgaacccatggaattagacgtcttagtattgcttcctacaaatagagcaccttacataaattttatattaaaaaaagctgaaaggtgagatgataaacaagagaatgagatgagaaaggagatatagatctcaggaaatgaatcaagaatggaaaatcataatgattatagaaaaaaatattcattagaaatagaagaaaacagaataggcccaggtaaaaatctttacacataaagatgaaaggtttgaaaaaaatcagagtaaatgaaaaaggaaaacagttagacaaagtagaaattctcaaacatgaaagaggctgcttgacagtgaaagccacacagtgaagagatgaacttaaaacaaacaaaaaactaaattcagaagtagagaaaacattatcaaagtaacgagggaacactgaatgcatttaaacaactattggattgtgtttatagggcagaaaacagatattataaagtaggggaatgtaaaaatattaataaagctggccagtgtgaggtgttagagagaggtgagatggaaggatgtgagaaatgctaatatccttccctttctgagcagggacagactccctgctgcttaaaatagaaacacatacttaaaaaaaagattcaaagcactgatttttaaaaatagtttatttaaccttaaagaggtctttttggaaatagtatctcttacgttaaggaagtatttagtacatttatagttccttcaactgcagttttaaatctgcttaattcagttaagtttaaatttaaattcagttaagtttaatttcagtttttaaaaataaatataacatcagtgatatgttcttatttttataattttttaaatctatccatccatctcctgaagaattcatataaagataggaagaaataaggaaagatgctgtgctgtgtttggtgaagaggaggggctttttctttcagcatcatacctctttacagtgtatgattttttataataggcatgtattctatgagaagtgttcattacacacccccacacaaagctaccatgtcaaaatactaacagtgattaattgtaagtagtaggtatattagttaggttgttttctcctgcagataaaagaacactctagtcaaaatgacagacaagtaggacatttatcatgtgataaagtagttgggtggttaggcagcaccaggtagtcaaaaatggcagcagcattcaggtccttcatatagctccactctgctggtcttagccttggttggtgtgatcctaagattggatcctccaatggtcacaaactgacttgtagcagttccaagcattatgtatgtttatgcataacaaattgcagagacaaaggttggatcctccaatggtcacaagttgactcgtagcagtttcaagcatcatgttatttatgcacgacaaactccagagacaaagaggggaaactgctgtcttggcgtctcttttaaaggaaagaaatcttacccagacttctccagcagatcatcctttattctatattgactagaatagcatcacctgcctattctttcacttgtttttcagaggagtgggacccatgactgagctgggaaggcaggatacctaaacctgctcaagtttctattgggaagaaccaagaagcaggaggaatagatgttagctaggcactagcagtatttgctacaacgtggatattggtgataagaagtttcttctttgcaattttatttactttttagtttccacaaatataataaagtaaatggactatgtttataatttccctttcagttgaactatgggtgttgactttcttttcatgaagataatatatctgtttaaatactaatgtaagtattttttactagtattgaatataagttttttattaatattgaatagattgcctttcttagtactgtctattgttagaagaagccccctaataaagagactgaagtaattgtagaagaaactggatctctctaagctattaatcatgttttctgaaggaaggagagtcaacattgtggcctcatgccttacaagcatttattataaacgtgaatagagtattcctttaatgttggcttcgaggcacacaaaattttttttgagaaatataataatatatgaattgttttcaatatatgaaaggaggattatcttaaaaatactcagaatgtgttcgccagtaggttgtcacaagtattacattttaagaatcatgaacaatttttacaatatggaatgataagcactacattttaacattttttttctgaatttgaatgctttgaaaataatttaattgaaataaaagctcatgcaaatgactttagaaaagaagctttcaagaagaaattcaaaaatatgttggcctctgcctcaaatgagtgttggctgtgccatggtcccccctgtttttgaaaggaagctgaagtgagtggttagcttgggatatgtggtgtccttcctgttggcagttttccccttttcttttcccagtaagttggcaataaggaagcaaagaaagaggaaatgcctggtgttcctagttccattcttcttcaactaagttggttgcacaaaacaaatttaatttaaacaacatttttcacaatactaaacgacctacactttcaagtgttatcagagaacgttatgtttaggtttactctgagttgctatgattcatgaatataagaataaatacttcttgtgtttttataagaatatattttccattcattatcataatgttaacttttccatagtaaaataagtgatgggcttttcgtgtacagtgtttcttaaatacccattaattaaatccaatgaaaaccacttttaaggaagaaagaaatttaccaaaccacagagtgtaactagtcatttgcttatgattaaactttttgcatgctgataaggttggaaatacccacgactttattttcctgcttctccttatggttcaccacttgtatcagaaacttttaaattcataatgtatgttcattattgacccagttgcagccatgtggatgttattttcaatttgcttgaggtacattttggtgaatgtctaaggcatgacattttcaaatgagaatgtcatgaagttgtttcaaaatttgaaacttgatattaaaaacaaaataaaccccccaaaatccagaaaacaaaaaataagtaaatttcactgagttttcattaaatgacatcatagcttgggagttcttgctttagtaaaaatgtgtttacccagaaggttttcagggaaccccatgtagggtgaataagaaaaagctcttgtgttaagcactgttttaactttattcttgatgatgcttttgaaatctcataatcaaaattcaagggtgtattttaagtacatgatttttacattaggaactatccattttaagttagaaagttatcaccacccgtttttgtttttttctgtcatactcctctctgatcttctagttgcttagttccaattttattttattttgttttgttctgttttttgagacaaagtctcactctgtcatccaggcaggagtgcagtggtatgatcttggctcactgcaacctccaccttctggttcaagtgattgtcctgcctcagcctcccaagtagctgggattacaggcatgtgccaccatgcctgactaatttttgtagttttagtagagatggggtttcgccatattggccaggctggtctcgaactcctgacctcaagtgatctgcccgccttggcctcccaaactgctggaattataggcatgagccgctgcgcccagcctagttccaattttagaggtcagtgattgtaagcatatttttttcaaaaatttttatgtcattcttttattattgacacaatggctaatgtttcaaaagtttctctgtgtatcacttgatcatttaatcctcaccacagtttaataatgcagtagttgttgcagcaatattggtgttttacagttgaggaaatatattcagagagataagaaatttactgatggttactgtaggtaggaaatggcagggtcgtgtttaaatggcagggtcctgcccctttttctcaaaaaatatttagcataggataattctgcttggtactaaaaatgtggacacatttatatatgtataaacaaatacctagacagacttcttaatcctgggaggtttaaggcacaaataggcaagcatgttgaaagttttgctggaagatccttacttcatgttctcagtgctagataattaaattcgaggaagttagcactatccagggctgagaggagcttaaggaaaccaagcttctatgagcgtgctcttttccttggagcagatgctctggacagaagcagcattcctgatgcatttggcacctgtttgccagtgttcatgatacacagatcatgagggtaaagttagccccgcttcaaaatagcaaattattattaatgtattttggcaggagaaagtaattttttttgaaatgttagcattatggggttcatttattttgaccaaaaggtttgaattatactcaccttggcatttaccttgaaatgtaaggttaataaagcctatatcaccactcaaatcctaatttcaacttgcaatgtgaaattctctagccacaataaagatctagctaacataattcagtttctacttattttgaatatatatctgtccaatttgggtccagtttggacaatttaggtgaaaactggatggctgtgtttatatgtattatcatcatactacgttttactttatcttgagttaattttgctttattggatgaatgtcatatgttctgtaggtggcttaagcgtaaaattcacccattacctactaatccaattatgcaaaagcccactcttggctttccaacaggtaatttttatgatcttatttgctatgagaatcttgagccatcttcaggaatcaatacattgtaaaagcattattgattatcacgttaatgattgacataatttattgccttcctaggggaaagaagctttcagaagatcattaaatgcattaaaacctgcagatgtccacatgtctgtgcctctctttagcagcctgactcctttgggtcagttattcttagcctcggtatttctatcttatggcatcgcaggtctaagattagcttgttaggcgttatcatgccatatgagttacctcctaatataactctacactggaatgattatttatagaaagagcattctgtcatttttgggttatttctagtagtttaaataaagaagaataacattcaagtgaaaccacagattccttcctgctgccaaaatagcatgataactgtctgcttaaggggcaataatgttgtttaaatgtgtgcttagggtgattgcagaattctttttatctctgccaccttgagagaaaagggagagctctggtaatgatgtatcatgcttatggaaaggcaaagaggcggccttgatgctgtctcagagcacacaggactctggttgatgatgacaacaagagacacacagggtttatttttagaaacagacattgctaagctctccatttggtgttaatattgctcataaacagagcttcttggggctgttgacccttctcgtgaatatggcattacacacacatactgttttcttttttcactttgtaagaatgattctattattgaaagtgtatatatatctgtttctaaaaattaagaaatctaaattctattcaatttctcaattttttttttttaatcccatgaagcttgggtttaagaattggtttatgaaaaacaattgactattataagcacaataaatatacaggttaactataagtatgggaaaaaggcaagtatacatcatgaatgacttttaataataaataacaccaatgctcctagctttattaccacaatatataaaatatagccataaaagatactgtcattataatgcactattgtgagttactgatttaaatagatgagataaaattctcagcatatgagaaaagtaagtgtaagcctctgcttgctgtttgggtattactacctcttgatgttcccagcaagtctcatatacagtaaaatatgcagttttacatttgagaagtgttctctcaatttactttgtgtgcttaattcaaaccttagcaattgttactttgctctaaaattagaattgtgttttaatgttaaattcgcattttatattttactattaactcatttttcctaaatgataaaaatgttaaaatggatgttagtgcattttatgttaaacatttgccaaatgctatagaatggataacttatgcaggtcttccaaatattcattacatattattattattattattattattattattactatttgagacggagtctcactctgtcgcccaggctggagtgcagtggcgcgatctcggctcactgcaagctccacctcccgggttcacaccaatctcccacctcagcctcccgagtagctggaactacaggcgcccgccaccacgcccggctagtttttttttgtatttttagtagagacggggtttcaccatgttagacaggatggtctagatctcctgacctcgtgatccgcccgcctcggcctcccaaagtgctggaattacaggcgtgagccaccgcacccggctattattattattattttttgagatgaggttttgctcttgttgcccaggctagagtgcaatggcgccctcttgggtcattgtaacctccgcctcccgggttcaagctattctgcctcagcctcctgagtagctgggattacacgcatgtgccaccaagcctggctaaatttgtatttttagtaaagatggggtttcttcacattggtcaggctggtctcgatctctcgacctcaggtgatccgcctgccttggcctcccatgtttttaaaagataaatatgttttgtgttttgtttggttatctgctgaccattaggaatttccaaaatgaaagacaaaaataggaaacacacagtaattgaaatgtatcttaaaagaagtcaagatggaaataaattcagagagtggaaatggaagcaactgaaggaacaacataacatgttgcatcctgaccactcttttaatgagcgggtcgaagactttggaagatgaaattgtttgaagctttgggaactggggtgaaagagtcatttatcggttcattttttcacccaaaactgttttaagaaccaaccatatgacacagaagatacagctattaaacaaagcaaggagatacatggttggttgttcaatggaatgatggatggatagataaagctacttgagataggaattagtattaaggtgaaataagagaatggggtagaaagtgactgatagggcagtattaactagggtagctagggtagttaagtgaaggcttttgagtctgctaacctgtaaagggtatctttctaaaaaaagtagattttccttcaacgtttaatttggtctaagtcaagtagaacagaagcacagttaaaatagattaggaatggtctggatctatttcaatattgttacctctgctttgtggaaaggatggggaagcatttagcagtaggtaggtaagggaactggagaaaggctgttagctatgattttctctgtttttcatagagatcgtgaaccaagtgcctctctcttgtattcatattattaacttgaagtgaaggctcttttagaacttgttccctttccttgttcctaaggttcacccttgtccctcatctcacctgccctgtcaattgtgcttaacatttcttacccaagcagtatgagtcattgctagtagttcagtgaagcaaacagtttctctttctcagaaacccaaaagaaggggagcagagtatcttcgccagctgaagttagaagtcttagaacattttctcataaacacaatattgcacactttttaaaggagtatgaaatacagtattcatcacacaggcatttactgtgtacctacaacgtgccaggtatttaattcaggtagatcatgggtcaaatcacacctttgttaggcggctggagaatcataacttcccaagaaaatatttagcatacatagcatacacagtcgtcgttgggttagcaactggctagattcgtgacatgttgttacaaaaaaatagttgtataaggaagtatttcatgaaggtgacacatctattttttaaaaagggagaaacagctaagagctatttttcctcacacattatgctttgtgaatagggaacaatggtggatacacagagtaggttggacaaacatttttgagggactgacacattatctcacatgcttgatgcctcatggggttttccctcaacattccaattggtctaagtcaaagcacaattagaatagagcaggaagtgttctggagctattttaatctccacttaacttctgccttgtggaaggggtggggaagcctttatcaatgggtaggtgggagaaccaggggaagactgtcagctacgattttctctagcctcaagaagactgagaccgagccaaactcctggccaacgtgctttgtggattcacagtgtagcttgagaaaaatggttagtggtgacttgttttttcccccgagtgattatctcattcaatcagtatttattgagtccttgaaagctgtattttttaaatgaggctgcttgtttatctgtttttgttgttgttgatttcttagtctaagaattaccaggtatttccttcttctgagataccttaatgctctattccaactggtcatcactggggaaaattctcttacaagcccaatgcaaatgttacctaatgtctgacaccatcactgatttcccctcacctctgtaatattaatacttccctaattacgtgtattttttttctctttctcccttctctctcgatcctcatagtccttttattactctctttagaacatttccactttctgtcttacactgtgactgtgtatgtgtgtcctcatccccccaattagttatattataagctccaagaggaaaaggatcatgttttacttctatttttattccctacagtacctagcatataattgatccctgagactatttttagataaatgaatgattaaagagtacagtgttattgcacaatgtgtttttatacatttggtatttttaaaaaatgatttcttcttttatgaagaaaattactcctcagtttctttgtagatttgaaaaatgtagacatttttgaggtgttagagctttttgcccccaaattaaaattattcattatagaatgtaagcaggaatgacctccaatgctttaacaatgtgtgtatgaccctttaaatgcttcagttattcttaacgaagggaatttgggaatattcttatttgatgtgatttttcaatgaataatgaatgccaatagaaatttcctgggatatgtgtctgcattcaaaatgtgaaatgtgaaatagctaatttaagactgcctgaatataaatgcatactttttttaatccaagagaagaataaatttagttgtgaaaatgattacaggtgtacttttatgttattcaaataacactttgcatttaatactatttttcccttctcctatgtttttatgtagagacaattttcttagataaggggcaaaaataggtggatttttctgttaataataatatcaattggaaataatttatccccacaattgctatctagctcatctacatttattctgacattatttaattagctatattatttgacaagggggcaaggaatgatgatttttgatgaacaatttaatcaaaatctcaatgccaagggtatcagtaatttgaaaaattatctaaagtaaaatgtcagaataaggagttaacatagtgagatattaaggaaatatagatggaatgggtgaatcaatctctatgtacaactcttctaagagaagaatgagaaaattatctttatgtgtatgtgggaaaggaatggtatagggaataagatataaatctttcagggtagtctttttgctctattttatccttaaaacagcataaattaggataagggcattaagacttagaaaattaattgagttcgttgataatagatgtgtgggctgagaaaggagttagataataaaaccgaattttacagcataggtgttgaacacagtgtagtatatcatggtgaacaaatgtatgccagtgtccttttagtgaatttgcaaaggctgccaattaggctttcttatcattgttcatttgtttgctaaaagatgaacataaaaatattagaaaaaaattatctgaataccagcttaacctaacttttatattgtaagaaggaaaacaaccctcaatcaactgatacccgtagtacccctagtctctcactatttattatcccagtaattaaatggacattcttccacatccttgatctggaaagatcaatatctttttctttttttactttttctttccagcacatagtttcaaatctgaatatagttataactctaacgttagaaacctctatctcagttcagtcttagatgactacaaaccaaactaaattgccaggtacagtggttcatgcctttaattccagcactttgggaggctgcggtgggaggattgcttgagccaggaagtcaaggcttcagtgagccgacatcactccattgcactccagcctgggcagcagagtgagactctgtctcaaataaataaataaacaaataaaagaaaagacaaatattaaattgtttagtggacacaggagacaacattgttctatttgattatctactgcccagtcagcttccttgggcactcaaccaacaggtaacagagattatctttatgcttcaccagtcatatatatgagacccactttcttcacacccctgccaatatattggatattgtcagactgtagatatttttgccaatcttaaagatgaaaatggtagagaattacttttttctgtgaatttttctgactactgttggattcgagtggttttcatatgctattagccatatgggttttcttttatggagagagaattccaggaatgcaagattggttaaaggaaaaaagtctatcagtgaatgttgccctgttaataatgaattaagcaaaaaaaaaaaaaaaaaaatcttctcattagatgtagaaaaacatgcaataaaattcagtatacttccagcatagaaactcttattaaactaaaaaatagaagagggaagtaagtattgttgaccaaaacccattcaccctatctgaaactttatatttaatggtaaaattaaaatacattctctttaatgtcaggaattgtctttggatgtcctagtcaatatttcaagacatgagcattcaataagatgtattagaaattaaaaggaaaataaaataattgaaataataaagagttcacttatattgctcagtacaaggtcagtacaaaataaaacattgaaaggactgttttatataaaaaacaaccaaacacaaaatgtaatagtgctagcatttacatggcaaatgaaacttttatggaaaaattaataacattgttgaagggcatataagaaaacttgatcagatttgagcgatgctatgctcaggaataggaagactacatctttaaaaagttatttattcccaaattaatctacatatctctttgtttttaaaacagttttttaaaaaagatgcttgatgaatagtattaagtcagatacactaagtgatgtataacaagaagtaaatcttatttccacctcaactctactaaccattcgatttcccacctcatacatagtctgctgtaaatttcttctatacattatatgtgtattatatttcagcacaatgttgattaaaatcctgacaggatctatgaaggaacaaggcatactgattccagaaattcaaatatacgagtaagtgtgcacaaatggcagttttgtaaagcaacaaatggagagaagaagcctagatgtcaagtcatacaaagctgtattaataatgattatttggtttgggcagggacatgctcacatagatgacaaggaatagaatacaacgttatttttagtagctttgtgtatgacagagtttgcatcacaaatcaatggaaagaggacaaactgttaattaaatagtttgggaacaattaatatattcagtttttaaactcatagccaaatgattttgtactcaaatatctatgtttgcaatactgttgttatccagttatgcaggttacaatttaaatttctgcaaagcctatgtattgtatcatgcatgtaggatcttgcattgtatagagggaccggaaggaattttatgaagatagggcagggactttagtaaagtggttctaaactaggtgagagaagtacacaatgtttatctagctcaattctcaaaaaataacttgagaccaaataaaagattcagatctatgagtacgatagagtgaaatagagaggtgataatttagtcaaagaagaaaggtagataactgtatcctaaagcttcaccaagttagtcactgaatagtgccttaaaagaccaatggagaagtgacttttaagctgatgcctgagtgactagaagagcccagccatgcaaagatcaaaggacagcaattccaggcagggggaacagccaatgccaaggcccttgagaccattatgtatttggctgttctcagaataaaggccactgtggctacatcactttcaacacaatagagaggattttcaggaggtttagccaaatctgccactgtctgtgtggagataggtaatctagctgtcttctctggcatctgtaagctaggatgggttgcctagattaccgttaggtccctgccatccttaaaaatgttagggatttgactttttaattccctaaaccagatcatatcgcaagactatgtctttcttgaacctccaaaataattttgatttagtgggcaaataaccccagtaatttgtttgatactgctagtttataatcctacagattttaggtttagaaacccattcacttctagcttatttaaacgttattgcttattttgaagcttatgccatgtctgactttggcttagaatgtgttgccttttcacaaaagtgttgtggtctgttatagacctgtttacaaagaactatcactaattgttatgacttatctagcttagtttgatacctcaaaacaatctgagtcaatctttctttttctgtggtgtgtatatgcgttgtatgtgtatatgcatatacaatgtatgtattacaactgtaattgaactatttcatatttttctctgtagcaagttatgtcattcttctaatagaagtagaaagaaatagatggaaaatttgactatatgccaaatttcttatagcttagaactatttattaccatcttagtaatgaagattattatttgattgtttatcagaaatataaagttgtatcgttagtgttcatgtttttcttccaatctctttgcccagtgactacatttgaattttctaggtcaatttaaaattgtatttcacttttaaaaattcggacttattttgggctaaaatagaaatttcagttaagcacaataacagagatgattgtaaaaatgcagaaattccagttaaatattaacacttaatataattaattgctgcaggtcagctgcttaataagtaaataattgtttccagctatcttttttccccagtttattttaatcaaaataattttcttggctgtgtgctgtggcccatgcctataaacctcaggatttggaaggctaaggtgggaggatagcttgaggccaggagtttgagactatccagggcaacatagtgagaccctgtctctacaaaaataaaaacgaaaaataattagctggctgttgtggtgtgtgcctgtagtcctagctactccggaggctgaggtgggagggttgcttgagtccaggaatttgagtttgaagtgagctatgatcatgccgctgcactctagcctggatgacacataagaccctgtctctaaagataataagaaaataataacaataaaaataattttcttcgttaaactagtattttgggataagtactacatagtccttaggaatttttattcataactttttctaaactccagtttatagtcatatggttaaaatttaaaaacagaaagagagattatattggttattggttctaaagtcatattttattgggttttacacctactatggtgatatttaaatgatgccaaagctacatgttgcaatcaagataacaagagtattttttccttcttcctcattccaatcttttgaaatgtaatgcatggaaatttttctttcatatgttaagtgtatctcattgctgaatatagtgtgcctcactgaagtattcacttcgttgccaaaaacacatcagtcattcacaaatattcagtattctgagaatgaaatttttttttagctacttgggtagttggtgaaagccagtttgcaaagatttctaactcctacagcgttagacatattatgtggaatccagggctaagcagcagctcccaaaacatgaggtagagttctagatacattggacccttcaggccacagtatcctggaccaagatttgtagccagttaacagaatggcagtaagcagtcttctattttgtcagtgagatcaaagagcattataattttggagaacaaagggggttccatccctgagcacattcattagcatttaaaggaaatagttataaaataaaaatacaatccctgagttaattaaaacatggagtttcaacataagcaaacctaaggcttagaagattggttgacatataataattgcttaatgaatattcatgggataagtgaatgaatgaatggattgaatatcatccatttacagcagctgatatttcaagtgcacatgtgcgtttgcactttaaatgttctaggctttttatcctgggttttctaggcataagatatataaagaatatattttaaaagccaatttttaattttaaaacttaaagggaagaagaacttcttttcattcttcatgatgcttttactaaggacacattattatttttatgaatattaactacgtcatacttcaaatatggaggttcttcagtcacacttaaaattttttgggttgttttcttcagacaaaaatggctttgcagctgtgattttatactcttcatcctgcctgcgggcctctttctagtagggccacattgtgtcatcctaatttattatgtgcagtatagttagagaataaaacctcagatggttgggcttattgcgttggtttctaaaatgaaatttaaaagacctttaagaaggatttcctctgggtaaatatattcagttatgctcatatccatagaaaatgtaatttggacaataaaaggccaaaatcacttgagtctttggtatgttctggatagctggtgtttttagagttgtgatttccaggaaggaggatgtcaccttaccgccctagtcaatatcctatttacttaagaacagaaacagggaaaggacaactcaaccttcctctcacctccttcacatgagaaccccagaggatgttctgatgtgtgtcaaattcacattctagatagtaatatattaggctgggtgcagtggttcacgcctgtaatcccagcactttgggaggccgaggtgggtggatcacctgaggtcaggagttttgagaacagcctggccaacatggccaaaccctgtctctactaaaagtacaaaacttagccaggcgtggtggtgtgtgcctgtagtcccagctacttgggaggctgaggcaggagaatcacttgaacccaggaggcagaggttgcagtaagccgagatcgtgccattgcactccagcctgggtgacagagtcagactccatttcagaaaaaaaaaaaaaaaaaaaaaaagatagtaatacattgagcatctgatctgccttagctgaaaaatcaaacatctggcataatggtaaaaaattatatagaaagattacttaaaaagacatctgattttaggcttctttttctggcaacaacaacaaccaccaccatcaccccaattcagccagcattctctacatttctaatttatgtttaaataaatatgaatatttagtccaagataaattttttgatcaaaactgatgatctcacacattgacagatttactttctggtatttaaagacaaacatattcagaaaggttaagcagtgcagggcgtcatgtgcttacaggaattgatatcttttaagagtccgtcattgtgactgcctcatttcacggcttgccacctgactctgttcttacaaacgataaaagttcaaataatacattatgaaaatgcgttctgaggatgttttatttacttgctactttccacttgtagtttcatgtcaagtatggtcccttacacctggtaagaactgaataccatgtttgggaatgaacgaactaaaggatcagcttgtgtgatgcgagagctgcctgcattatttcctcccctccatttctcctcttttacagtctagagtctagtatggctgctctcatagttcttctatacattcattctaaagaattagctgtaatctattacacatcatataccaactttgttattctcttgtcagtcacatatcttttctcaacactgatttgaacatttgtccatctttcagaacacgatgttgcaggtagaagagtacaagttaagacaggatgccttaattaaagaagaggcctttactcctgttttcttccattctcacccctctgtttctgccagaattgtgacagcagggcagaaaatgggcttttcgtgcagagttgacaagatacagggtagtgaagacaagaatcttctttcacatgctaagaaactcctgactatacttctgaagtagtaattggaatgacagcttttctggctgaagtacaatttttttgttttaaaaatacaaatggtccctctcattttctattcccagttctttcactcacatgctcacacttacagttatacagtgttcacacatacatttttcattgttttctcatttgaaataaaatgttatgagaaattttcaccataagcaaataatcacttattttatttgttttaattgagcttttaaaaggacattatttattattatttcacacactcgtgcatttattgatttactctctcccacagtgattgatttaccggtatttatcttctccaactagactgacttctaatgactcatttatttgggaacttcttctatacgaatcaaaatcaagagtttgaagtaacccagaaagagacttggagagcccaagggatctgtgaatgagctttaggcagtttctgaatctaagaaaattgtctgcaaacaaatatatttgtgtacatatgcatttttggggagagactgtcaattccatgtcttaatactcaaagaagtttgtgtccctagcaaacgtaagtgatcaattttagaaagagtgataacaaatttgattatttgggtcttcagcccaagactaaaaggcatagattacaagcaggggagtttactagatttagactacctaaagacttacctagagccacagcacacaataaaaagcaaaaagaaaaccaacccatcttccaaatatagaaaaggtcgagaaattaatgcaaaagcttgtcccacctccattaaagccgactgctgtatttaactggccctgagggaaccacagtttcacaatgcagttacggaaaggccagtaatagccctggctggctcctccatgtcatagatatctttaaaatcagagatgtatctaacccattttggaaagcataccttaaaacattaaagtgtttttgatatttcaaggaaaaggcttccgacatgtgaaatgtttattttctagattctcttattccaaaatgaaatcaaacgtgtatgaagctgtgggatgtgtcgtttgccccttgaagctatagtgtggtagaaattgaatctttatgtccagaagcccagtgtctgtattattagttttgcaaacatctgtgggctctaagtgattgataaatactatgtatagaattaacctaaagtttagtttgaagaccctacttcatagatcaatatgaaaatgatgccagcaaaaaatatagtttagacattgtgccttggaaaaatatttctatttatattaatgagcttatgtgatgtcatcacaactcattctaggaaagatctaggtcagtgtaatcctatctagagaaagttaaaaaagaataattgttgacttggtattcttcgtagtcagaaacaaattaaatgacaaattatgacactattttttattacatgacagacaaataaaaagttaccatatattaaatgctcaagaggttaatatctataaagcagaaatataaactgtaaatcagtaagaaataccagtaactcagtggataaataatcaaaggctatgaataagacatttacaaaggaataaccaaaaataggcagtaagtatccgagaagatgatcaatctttgtcatgattaacacatcaatgaggtgccatttttgtcaacattatgggagtaaaaataaatgactagataatgcttagtgttgattgtggtttggaggaaaggggtgttgtcatgtattagtggaagagcacactgttcaaattttggagcagcataaattggcagtactataaaaattaaaaatctacacacccaacaatctagtaattccacttaattggtatacagaaatacttgcacaaattcacaataatttatgtaccaggatatttatcagcagttttatttataataatggaaaactgagggcaatctaactataagtcaatacataatccatactctgaaatacaagtcattaaagttattaagtaatgtctgaagatattaacatagaaggatgagctcaatatattaatgaatgcaaaaaaatgtagaatggtatacagtacatatagcatagtaagctcaactaatggattcatggtacttgtttccattattttattgttgtagtaggagcagaaaagtagtaaaagtattttaacccaaagaaaaaaaatgctagcatgaaaatcacagttcaataaagtgtttttatatcagtatgtttattaataattaaaagtattaataagtttacttcaggaataagattaatttacgtatctgtgagaaacttcgtgatatacatcaaaatattaaagtaatcatgctatatttttcttttcattctgaagaccacctcttgcaggtaactttttctattttattatactgtcctattctcctttctttacttagttatatatcacaactatagaagaaataggttacctgttacttgcagaaatgtcactcactattaatattactttgcaacacagaaaatttttctgaataattagaggcaactaagcaagcctaaatggagttggttaattaagttataaaattctaagggagtatgatgaaccatgtagacatatgagctttctgttctgcttttttatcaaatgtttctggcacctgggttttctcaactgcccttctgttgaatatgattttcgaattgatgtaatgaagagtggtgctctctggacaagtaagctgttcatttgtagaataataatatgtcaacacatattttccaaaataacagtcctactaccgtaaatgtcttggaaacagttacctgacacccagagagtaagtacaactagcctagagccttggtctgacaccaagcaagagggtttatgaaagaagatagcccagaaagctggagtcctgctctgctgtgtcgacatgtctacagctcagaataaaattgagtttcctgctttagccatagctgggtcttaaaataacctgaagaaattatagttctgattacatagaaagtgaaggacttagaacattctcctaataaagccatgagaatgacacaaagcttagtcatcggcagtcctcctctaacaggcgttttagagagaaaaatagaggtttgaaattggataatttgatttgaaatcttgcctaattattttaagaatgcagaaaacctttcttttttggccaaaaaaataatgatctggaatccaattaggaaagaacaggcttttaaaatgtttgatatctccagtaatggagaaaaatcatgtctttaaaattacattctgctacaaacctcattcttggatgtcttgctttttgcattttgaatggacaaatttaatgtaatttccttttggaaacatggcattggaaaagttagatgagatgtttaattttatgttggatcctatctaccagggtacagatttttaagaagaaaaacacttcttgtttcgttttatttcccaagggagatatctcacttaaccagatgccttgcgatttgtcacaatatagatcatttacacagaatttgtgtccagtcgtccatctatttgatttgcacaccatgaataaaataagcaaaatggataaagcttctaatactcccaattaaaaaattgctatctattttttcaccattaatatgctatcccaaatggcatttatcaccatactgtctcaccatatttattcgtatgctgttgttttctcaagatacgttcaattcagattatgtttgacttgcagccatatcaataatatgactaataataaacaacagtctaggatttccagtttttagaaaaacgataataaatttgaagtgaacctatattcagatttacattttacttagtattgtttttaaaaaaacattcaattaatattctgaaatgattccatttatttttactacaaagttagctggacctttacagcattttagagttttacacgaggtttagatttgactaagccttagtacgatgtctggaaacaggaggttgaatgaacatttgttgaaaggaaaaatcagttattgaaatattgtgtcttctgttatcattcttgagaaatggtggtgagacaacttagtagaagtgactaacaactacatatatacagaagacaggatgtaagtctccaaggtaatcaagaccaacaggaggatgttagaccaaaattaacaccgcgagaaatgtgttatgcatatattacagcccacgtgtgaaaatctgttcatttatagagagattgcttctctgtgaatggctaagttggctccactaagtacaaaaaagcacttagggccattcagaactaacagccacacactctgaaagactaaaccaaaagatacctgattagtaagtgctctttagatgtggggatagacgttttaacaaagaaaggacagggatggagaggactaaagctccgtgctgggaaactcttaaggagccagggcctcccaacaatatgctaagagtgcacccctagctgtctggccacattttcatttcttgtctcaatcctgaggattaatcatgaattccagtccagtttctttccaagcatataactggacatgacagagtatcttagcttctacatcataaagctcaattgttaatactgaaaaaaaaaaagcagggtggtttttttaaaaaaaacaaaaaacaaaaaacaaaaaaaaaaacatctaatgagcaaacaaaccaaacatgcctctcttatttcttgtcctgtctattttttatttaagcgctgtaggtgaggtaattgaaatggagcccatgatatgtcttaagaaggattaataacattcagtgaccattaagtgctatgaattttcaatgtataatgttttatttgtttctcccaggaatcctctttgtaggtggtaaaaatcatttaacaagtgaggaaactgagctcaaagaggctgaataactttaattaacaagcatttatggatgtccactgtatttaggccaaagtaaatgatgtagtgtcttgcttccaagagcacattgtctagagtggaggaaaaaggcaaagtaaacatgagagaataggtgctaaaactagactttgcaatattgagaaggcctgggaagcctttcaaaggaaataaatgaaggggagttcagtgtttttgaagatggttggaggacatgatctataatgttgccatggctggagatgacactgcaaaccaggcaggagacagatgattaaggacctttaattccatgcaaagctagtgactttgaacttctaaaggattttaagaagagctgcatgatcagaaatacttcttggaaaagtaactttagctgctgtataaaggatgggacactccttaaaatgggttgtgtaattatcacataacctctaactattaactagaagtgcccagcaaggaatagggagagaatagtaagagtgaactggaaggaccagaaagagataaattgggaattcatgcaagaggtaaagggacaaattcagagtctgagatttccacattcataactgggtagatgtgttgccattattcattcattaattattttttgagtgtctcttatgtgccagacattatcttcgtgccaaaatagatgacagagcaaaacaaccttatatatttgcccttgtggaatgtgaaatctacactgtttgcacatgtatatgtgtgtgtgtgttgggagactgataataaattataaatgtacataattatgtaattggttagaaatggtgctgttagatgaacaaaaggtagggcagagaaaggtggttcatgagttgggagagaaaggtgcaccatcacatagagtagttagagtaggtaatttttatgaaggtaagattttcagcaaaggattggagaaggattgttaaggtgaggaattacacaagagacagatgaggagatttaaatgtagaccccgccctcccccacctccccctccccgctccgccctgcttcccattgcttgtcttgctattcacctggactggcagaataagcgtggagcttggtaggtaacattgattgactatcacaaaatgaagtgtagagcaacactgagagtaggaaaaccttacactatgaaaacatagaggggaaagaagcacttcttcatctggctgggttagctattctcaggataggtactcaagtatggaaggtatatagagattgggccttggcatacattcatatctacacagatagcatctatttacctgtgtagtgaatgtgagcatgataattcatgtaattaactgccatatttcttgtagggactgaaagttaacaactttgtatattaatactctaagagaactctaactatagtctccaacaagaattgcagggattttaaactcataattactcctcagctgtaaatttcagatgtgggttattgctttttctcatttaggggagtgaaattgcttcagccatcgactttgtgatgaggcctgcagtcagctgtagttgagaggggtgctcactctctgctattattagtagtttgtccacgtaaagacaatcatacaacatgtacaaaagttggattcaggatagcaacatattatgttttgtggctgcaagatatttaaatctaacaccaatagcataacgtttaaaaacaaaaattttattgaaaataaagtttatgtttggggcaaaggaagattaagaggataggaatatatattttcccattcttaactctgtctctcttctagggattgagagatacagagagattgagagagtgaattggagtgagtggatatgagttatatagcactgcctaatggattattacctcccaaacccctgagttgaagagtagatggagagcctgtgtaaaagattttgggtagacgattttgaaataaaacttagtgacatacacacacacacacacacacacacacacacacacacacattacagataagtatatatatggaaaaatatgtatacgcaaggaaaatactgctgttctaaatgtagtataatgattttaatatactacccaagaaatcttatgagactttaaaatcattttaagatttaataatagtaatggatttaatttttttagtatgctattcattacaaactagaaaaatcctaataaatcagtctgaatcagtaaagcctcatagatttccatgcaataatgtgtttcctcagttgcttttacaggaaaataattactaattatttgataaatttaattttggagcaaatgtgttgacagctgaaaaaacatgtaatgacttggatagagaccagatataacactagaacaaataatattggcgacttaaaaaaatagtaactgatgaaaaaaatctaattgcgttaaatattttaaagtacctaaaaataccaaggattttgtatcttttgtccttttctacttgaaatttcttaatcattttggtgatcatacaagataaatctttaaaattactgtgtgagtattcttaaaataaatataattctttggttaaactatacttctctaaattacatgcagtcttaataaaataattcctatggatgttaatgttcattctaaacaattttgctcaatccatatttttgtaaactgcattgctttgctttttttaaaagctactgtttatatagtcctagttcccagtttttcatatatactgtattgtgtctttaaaattagaaatgctgctgaaacatagaatatattaatccttgatgaaatgggacctctctttgagtataggactgttgcctgtacaactaagtctagtctttcagaacagaataggatgctgtatatctgttccctggaacttagatcctttggccttggttctacctgactttgagaaattacaatccctagtttttgtacatgtttcacttactttctgcatacgatttctggcttacttgactcttaagttcttgctgccagtcttgcctctgcagcagtccacattctctcaccaccaaagacataatgtcttgtggcttccccacttttatctctttgcctgctactcaacatttgttctgcaccagatgaaagtcactgttttaggtactttttaggggtacataaataattatttccttcaagaagccagcaatctgcataggaaaggttcacaaagcaattttgaaataatttaataagtctgcataatggattatcacatgagctttgtaatttatactattttgttggaattgtatagcaatatttataagttgttactatttgagaattcttgtgtcttaaatcatcttcctattagactgatatacaagtctccccattgaccacccccaatgccaaaaagaagcatgctgtgaacactgcaaagtaaactattagaaattaatggtcactacctataaagatagcaaaatactaaaggggtggtattttatgagcaatggaaacttttgttgtagatatttcaactgacactgtgcctttattactactttatacctacatctgaagatccagactctagtagttgtaatacaatagatgcaaacagtgggaacatctagttcttgtcaatgtgtcaccaaaacatattatcaaagctaatctcataagggtgtcagaggaaattaaagttgcctttggctgcatgttataagaactgactgaaattttaaactacctcagtagctgactatatacagcagcaggaagccttcaattaactgcaccagttctatttgtagtacaaaggatctatggcttaggatagcctacataacttaaaaagaaaaaaactcaactagatcttaacagtatcctgaagtacagcctgagagaaaaggatagatagggtcagataggagcatggagcatagtaactaattcaaagacaagggggtcttaggttgagctttaaaaaatgttctgtctagtcaataagaaattcagagacaatgtctttgaaagaaaggtaagccagaatgaagagtagcagtctacattctagagattataacaataaaagtcagcaatattaaatgatttagtatagaaaaaggtgagcttttacaagaataatggatagaaaagagttcttgaggttattaagtagaaattcacatggatttaataatgaaagatcatttccacatgatcctcaggccctgtttcttggactgtaattaagaagaaaaatggaagaacactaagagaaaggactaggaagtggtagtggctctaatgttcttcttttaccttttgaaatgctacctgatactaatttttgagaaaaatttgttggagagtgaaacttgcatgtcttttggataattttatttaaaggtgaatgatctcaattttaccttctttgtttttcacagttgcctccctctccttttgctatatggactatatgtatctaagtaagttaatgttggaaaaaagtttaaacattgagaaaattactgagggtgtctgggtaatatctcagaattagatttgaaagtcactgaacgatatgttgtggctcaatgaggaagttgttagatttgtgataataccgaaaaaaatccctcttttggttttatctaaattagcattcacaatacaaaagtcattctaagaattataattaggagtctgacattttacacagaatttggtagttatttttggtaaataatttttacagaggatgtttgatcaaattaaaatgtaaaaattttaaggatcaacctatgattttcttgtattaatatattcacgtgggatctaaatgctgaaaaattgtattattattttttctagtttcaaatctaccagaatgtttatctataacaacttctatacagaagttgtttaaagttcatggaaactatcttctgtaggagacagtttacagtttacagttctgtaaaatgaatcataaaatccagaattttgctccacttgtcccattactgatccataaaaactggatttaatttctactgtagttatttttaaaaaatacacatttggtaccttaagaatgaaataattataggtcgggcatggtggttcacttctgtaatcccagcaatttgggagggcgaggcagtaggatcacttgaactcaagttcaagtggagtttgagaccaggctgagcaataaagcaagactcagtctctacgaaaataaaaataaaaataaaagtaaaaaagtaagccaggtgtggtggcacatgggaagctgaggtgggaggattggggaggtcgagggtgcttctgtagaagttttccatgaagtatttttttttttttaaattaggtcgaattaatttgcttatttttcagaaaatagattttggagctggtaagaagaaatgagaaatactaatatagcatattagaacaaataacattttatataagtgaaaacagaaaaaaattaggtaaaatgatatatttataagcccagtgaaggaaatggaatgaattatcttctgggttttcagaccaaatggactgtcagatcctttagttaaaaatttgaaatatcacctttaaaattaaggtttagtcttctcttctttgccactttacttacttttcagggcattaaaaattacttagcaaactcataattatgtaccagaataattccctttaataggaattttattctaggaaatcatttctaaaagtgataaaattttaccaatttacaaatacttttgtactaacagtattaataacaatgaattttatagtagtgatagatacataaggagacaggaatcgatgagcatgggacttattatggaatatagttgaccatgtttcaacatatgaagtattattagaaagtgatacctctctacctccactcttctttctaactttaacaatttcctgcccagtctagggtgtgcatatttggaattatacctatttacaaaggaaccacataagtaaaaaacatgagataaaatggctattttagccatcagagtttttctggggtatttgtattacatttctgttttcttgcttgatgtctttatccttctgtcatgtgaatctctttattcccaaacatttgtctgggtattaaaccttttttcttatatgactcaatgttaagagagcctcaaacagctaaacaaaataacaatgagtggaaaatttctgtagccaagaagaaaattaaaaataggagacagaaaataaccagagaagaaaaaaaaaatcttttgaaaaatggtcaaatgtcatccagataaccttccaaggaaagctgcctctcatctccttcccccttcttttccttcctcatcttcctaaggttgtcagttggcataggacataaaagtaaataaaaagatgggcataaaagcaaatcaaaagtggtaggaaagcagccaataaaaatggggaggtattgtcccagaataaggacagagattttactttagccaattccaagttaagttttcatccaacacttagtttggtatttacatgaatgcttgtatagatttccaaagtagatgccaaagtagattgaggaagttagtggattagtccctagggtttgtttgttaaaagaatttgagaagcttcccataataactttaacataacagaaaagaaaactgataattgtgtgtatttcgtgtatttatggttatatacattatgtagtttatttcatccatagacttgttttttctcaatcatttctttagttgttttagaattaagaaaatgcattcatacattgttgaggaaagagtcttgaactcattggattcaccaatgtttaaaatctttattgcaccaatttttttaaatctttattggttttcattgatctgatgtggttcatgattttccatgacattcactcttttaaaatgaatcataaaatccagcattttgctctgcttgtcccattacttatccataaaaactagatttaatttctactgtaattatttttttaaaatacacatttagtgctttaagaatggaataattacaggtcgggcacggtggttcacttccgtaatcccagcaatttgggggggtgtggcaggaggatcacttgaacccaagttcaagtggagtttgagaccaggctgggcaacaaagcaagatccagtctctacgtaaatagaaataaaaataaaaaaaataagccaggcatggtggcacatgggaggctgaggtggaaggattggggaggttgaggctgtagtgaaccatgatcatgccactcctgttctgcctgggcaacagagtgagatcctgtcttaaaacaaaacaaaaaagaatggaacaattataaaataatgtatgttctatctgaaaacaatgtcgttaacactttatggaagctgtccccagagttgagggacacttgctgatgtgaagttagccaacacatgactgcttcagaatagaaacaatgttcaatggtgttgaacaaaaaaaaaatgcacccttgctaaagctacttctaatgctgtgtagctctaacaaatgatttatactggttttccatttaatgagctggcagggaggatttttagctactgcaaaatcttctagaaaaaaaagaaacttgttgagaagtctctgaaagggtgtgaagtttcttattttacattcattaactttttattttattcaaagttcagaaataggctattggtcatgcattgtgaactcaccatctggctccatccagcttcctgagggatttcccccagtgtcacagtcttctgatgtacttcatgtttgtaaaagttttgaatgcttaattatatatataaaatatatatttatatatgtatgtgtatatgtatatataaatacatatatgtaacacttataaaagtgtgagaatttaaatatagatacatagttaaaaaaatcaatcggtatataaaggcttacagtgaaaagaaattatcctctatttcacttcagcttcagcccgactcgtttcagtactccagccctgcctcccatattagccattttaacaattttttactcgtatgcttctagtgcaacctctctgtctttaaataatattcttgctttattcactttcagcattgtctattgacttaatgcatggtaataagaataactcaccaatttttctcttttctcccctgcttcaaactatacttactttattcttagttcattcatttattataataattattattaattagtgttcagaaacctcaggaagaataattctcttaactggtttctaagttgttgagatatgtgtggatctgaatgatttggaaagtaagtaagtggactagcaaactgtaagcatcatataaatatgctttattaaggaatgtggttacactcaaattactcttttacttaagaaaataagaatttaaaccacttgacataaactgcaggaaattgttgaatgatttatcttaatttaatttctttaaattctttcctgtgatgtgctaatatgtatgtaattaagaaccaaatgagaaatgtactcttgaaaaaaactttaagttttgaaaaccttataaaaatataaaaagtcatttttcccctatgattaaagaaaatcaagttaatgcatgacctatatgttgctccttgacagtctttaatagacaaaatactggatttcctataaataagaaaatggaaaggaaaaaatcctctgttcctttcatacttttaccccctaactctttaactatacaatgtagttcggcctctaatgtgcttgtgtaagcaaaactcaatacccttaacctccgagaaccacacttctactgttggagttctattgaactccatttcaatgcaaacaagtaaaggaaatgtttaaaaagttgacgtgtgatgagaaatgaactcttttatgttttgtcaaaatttggtgcttctggaaaaaaattgtcaaatacattttttggtccaaagctttcattttatatttaaagaattaaaaggctgggcacagtggctcaagcctgtaatcccagcactttgggaggccgaggcaggtggattacctgaggtcaggagtttgagaccagactggccaacatggtgaaaccctgtctctactaaaaatacaaaatattatctgggcatggtggtgcacacctgtagtcccagctacttgggaggctgaggcaggagaattgcttgaacctgggaggtggaggttgcagtgagcccagatcacaccactgcagtccagcctgtgagacgccatctcagaacaacaacaacaacaaaaaaccaaaacaaacaaacaaaaaaccacaaagaattaaaatacttccatactaaggcatcacattttggccatccaggaacactgttgcctacagtaagattatgagctctcctagaggtatgattctaaagcaagattaatgcatttgattatttctggatacagggatgggaagagaagtggtctaattattcatttaaaatataccaattccaaaaattaatttgttctttcttgtttaattatatgattttcttagaacatcataaacttcttgtttatgcctcttctctctactctgaatattgactatcgtgagagctgttcaggcattaaacaccgatttgaattttgggttctctatgagtgaacaagtaaaattatcaaaacgttatatattgatcctataccgtttttgttttaaatcaaagtaagtcatgcatttagtttaaaaaggaaaaggtcttttaatgaaaatagcagttctctactctgcctctccccaatcctccttttcactccacagcagcaactaccttcaacagttctggctttcttctgtttttttttttaactttaatatttctaaataacatatccgtttagaaaattatttgtttatgcattttaagcactatgcattgttttctcagcctgtgagatgaggaggttcccctgtacccatatgtgttcacccacaggagtgtgcttgtgtgtgtgcacacacacaaatatgtacacttttcttctctactcttcccagtagttgaatcaaatcaatagtatttatatgactagtcaaatgtttactgctgaaccaagtcatgtattataaccatgtcaattttcaagttcaacttaggcttttttctgaagttcattgcaaaatcgtaccctctatttatctggttttgtatacttgcatgtttctaccatgtgcttaaaaataaatattttccacacctgcagcacttcaactctattttctccgggagtttccagccttctttctctattgggaactaattgctttaggctccccactcatccttggtctgttcctttgctgttcttttgcgtaatcctctctttcttggattcttgtagcttctttgtcggttttatttttgttttaattttcagaagaatattttacaatagcttatatttgttgaatttttacatacctgaaaatgtcatttttctatctttttcaatgatagatttgtatgactgggcatagaacccttgtggaaaattattgtgagttctagtcccaatttgactctctttcctttgcatttggcttccccaacacatttggaagctttttagaatcttctctttatctctgtggttctaaaattgtataacagtgtatcttaccttattcattttctcggttattctatggcctctttcaccttggaggcttatgttttcagtatttagatactcactcgaattattttcctttctttaatataacttcttctcctttgtgttctctactcttatttttctgcagttcttactagttcagtgttagaccttctgattagagtctaattgtattttctttcaggtagatttagttcactttgtcttcaagaacatttagtgacattttaatttaagttactgagtttttaatttcaaagagtttaaaatttttttttaagtttttcatcaaagtgcaccgttctttattttaatgtagtaggtaacttcctctattcgatagaggctattaattatagttaaccacattttaatttttctgcgtgcactttatactttttctctgctctcctcctttcatgtttgttttgatctctcctgcgtgttgggagccttcatatttaaaatgagcatttgatctttggaagctcatcatttgtgtggcaattgtagcatagaggggttctggtatagacggcatggacatttagcagccctttcagtgggtacatgtgtgtttgtgtgtatgtggttagaaagaatccttgcatgtgcaggcgtgatggctcacagctgtaatgctagcactttgggaggctgaggcaggagggctgtttgagaccagcctggacaacacggtgtgaccctgtttctacaaaacaacaacaacaacaaattagccaggcatggcagtgcatgcctgtagttcctgctactttggaggctgaggcaggaggattacttgagccttagaggtcaaggctgaagtgagctatgattgtgccactgcacttcagcttgggtaacagaataagaccttgtctaaaaaaaaatttagagagagagagaaaaagagagaatccttgcgtactagtgtctgcatttctcaccttatgagtcgttaggtgtctcaaggaaagaattttcccagcttctacttgaaggcaacgtgcttgtttgccagagctggggaagtagatgggtgagtgtgctttgtggaactgcactcgatccaccactgtgcagctcttgtgtcccacgtttctgctagagctgtggcctcacctcagttttgtttgtccagggaataactctttattcttctagtgaaaagaagggtagtaaatacagagagtggcagggacttagagaggaggagaaatgtcttggctgtgagggtatgggcatggtgatttaaggatgctacaatcagaccttaaaccagtccctgcgcttttgaccttgcgcttgaccactcgtcttcctctgtgcctttctgcaagttctgaacctcttagggattctctggcatgaggctgcttgttgctcactcactgcagttacttcgggttgtgctttctcctttcagtggggctgttaatcactatccaactcactttccatcttcagcaattcactgaactctcctgctcattcttgtcatctcttccctcttctttttttgctgtaggtttatagcattttaattcttttactgtcattttatggcatttctgaagggagtagaaataaatgcatttggtcaatccatcatttttattcagaagtcatacaatttttaaatcacccccaaattgatataataaatattattgttgatgttcttattattatttataatatgaaatattttaagttcataatactggagccattctgagaaagttcctaaaatagactactgcggaagcccattattgccatggacctgatatatttacatctataattttaatgaggatgtcataagattaaaatttgtgatggacatttgtgatctctctcaatgatgatctctattatatctacatacattcatttctttattaatagctcatccatgcagaactcaattatccaacaatctcattttattgataacaaatgctagaaaaagaaagtatcagaaatggctttgaaacaacgtttgcattgaatctacaaacatttttctggggatagcccataaaggcattaagcaaaaaaaaaaaaaaaaaaaaaaaaaaaaatttacttctatttcataaccaagtacaacagcttttgaaatttacatttcaaatacacagaacttagcaaacaaaacagaagaaaataagagggagcctgtgaacagacaaggaatgatcaatgaaactctacaataaagaggaagagaggggaaccagatggtagccaaagcaactcacattcctattaggagcttgtaggagaagctgtagatgccccactcaaacctcccagggctctgtcatttttatgttccccggcctggctcttgtctgcataaacctctctttgcctcagagctttcttttgtagttcaagcctacactgcaacccaggtgcatgacaggttaaaagtgccagagaattaatgccaccaggaagcagcctgcaatgaatgactggcagaattgatgtgtaaatatcccagcttccttgccccttggttaagtctaaagtatgtgttgtgcactggtgaccagaggtccctggaaggatgaagctccagttgtcactgtggtaatctgcctgctttcttggctgccttcctttactgtctcatttctctactctactataagcatgatgttttcccgaatcagctcccacctaaaccacaaatttgaactaaaatttgtaacttaatttggaagagcccaaaataagaaagaactatttagatttggagaacaattacgtattcctcaacaggacattattatatgtacaaaaagtgaaatatttaattttcaggatgacccacattcagtgaggaaacattcagttacattcaatatattctatttaagaacataaggatcatgtatatgtttaagaagacttctacttaatctagctaatacattatggttccagtgtttgacctttacttatatggaaatttaaaccaccctgaatgattcatctgattaaaattctggatatataagagctcttgggttaaggaaaacacgtgtgaatgttaaggtactttaaggaaataggagattattaactaaattgtatacaacaaaaatcctccataagcctctgtaaattcaagagaatatactagggagggtattaaataagttagttatagttactactcttttggaagatagaatattctaaaatatttaaaaagttaacacatttatgaaataaatgcttgcataaaatactatgtgtatatctgtgtgtgctttctcccagcttcccctggaaattagtttactagaatatccttattgctaacacatttccacgttctcctgactctcttgggatcatctgaactatggggctaacttactctcactctactacaaaaatttaactaacaggaataatcgtaaagcaaacattttaagtgtatcctgaataaaaaattgtctccatgcttctccattctgctttctcatcttctaacaaaaactaccagaagagactaaggactaaattttgggacaggtgaaggagagagttgaatctctctgccaggagaatggaagaaacatatctgttatcgttgttgtttctagaggaatggaaccaaactaaggggtttgggatagaggagaaaaggtttggaaaaggaataagagagaggagccaatagacttgaaaaatagcttgtatcgaattgcattttacagtgattgtgctgcactcatctccaatgctacaataaaatcaaatgcccacaaaaagaccacaaattaatgagtgatttatttttaaataaataaaataaatagggatcaaaagcagaaacttttttttttttctaatttctgtcaacaacagaatcaatgccaggacagggataaaggtggaaaatgcaaagccaaaaacaataatttagtggaaacaggaagttaaagccagaagtaaccttaaggttctaagtccttggaaattcccttacatacagagaaagccattggatttttgtatatggagggaatactggttcatcccagtctgacccaaaagttatgcgggagaatagttaagttccagagagatgtagctaatgtctgagtatctacttagtggccacagacattgaaaatcttgaaaatgcccaaatcttgaacttgagcacttcagttttagccacaagagtgaagaggtagaccagcagctttcctaaggcctcagttgatgggccttgccttcagtccttcataacctcaggcagcatcatcctctgtgcccaacgtgacctctgctctattctgtgcttcacaagcttaatggacttactttgtagtagaccactcattcttctacagtcttgattgtatggaaagagggaaactacagtagtttttttctgtaacaattgtctgctgttattttctgtacatttctctggcattcaccctgaattcattttctggtcatgcattaacttacattctcccgtggggtctcactttccatttagtcctcctgttcctagacttgatgatgtttatctgtgttgtctggtatcctactagtgacaggtcctgtttatcagtttgctaattatcacacagctcagccacagccttgtgaaataaacatactagttaagtatggtggtatgttaaggagtaaaagtaaagtctgtgagttgcatacttagaaaccgtgacaggaatttatcgcttcattctcattgacatttatgttgtggtagatgaaaggacagtctgacaagaagagagcacgtgtttgggaatcagatattcatacacttgaattttatttttaccccttactaactaatagctatttaacggccatgagccttaattcccttgtgaagtcaggatggtaatacttgactcatgtgtgcagttataagtaaaaggaaagcaccctctacatgataactttcacatgataggggtatggataaattatgcttgcaatagcatagtcataataatacttttaaattagtgactcacttccaagaatggagtataggaaagtgaaaattgtaaaattataatgaagaaacctggcagaaacctctttaaccaagtttcattctgttttctacttctgtgttagaatgctggagactgtgtaatttatagaaaaaaagaaatatatttcttacagttcaggaggatagggagttcaaggtggaggggctgcctctagggagggctttttactgtgtgatgcagaggctatcacatgatgagagggcaagagcatgccagctcaggtctctctttatcttcttgtaaagccacaagttccaccatggggcctctaccctgatgaccttatctcatcttaattacctcccaaaagccccacctccaaatgctatcaacatatgaatttggagattaaatttcaaacaaatgaaatttagggaacacagaaacacattcacacaatggcaccaagttatcaaggtgaacatcaccagtgataagtcatgtggctctactctacttatgtgggtgtgataggaagggcacttcacctcgttgtttttcccccaaatttatatcctcagtccaatcacaaaaaaacaccagacaaattcaaattcaggaatattctataaaatacttgatcaggaatcttcaaaaagcatgtaggtcatgaaaaacaaggaaagatgggaaactgtcacagatcagaggagacagcaagtaaatgcaacctgggaccctggattagatcttagaacagcaaaaaggatactagtaaaaactgatgaaattcaaataaaatctgtagtttagtaaacggtattgtactcacgttaatttctttgttttaacaaatgtcttatggttatctaagatggtaacatggaaaactgggtgaaaggtatatgggaacttatactatcttgaaaacttttctgaaaatctgaaattattccaaacaaaaagtttgttgttgttgttgttgttgttgttgtttaaactgaaaaggaaaaacatttggtaggtaacagatcagtggttgccaggggttagggtacggggagcataagggagattttaggggtgatgaggctcttctacatcttgcttgtgattatagttatttgaatctataaatgtgttaaaatgaggacaccaaaaatgtcaattttaccatatgccaatttgtttaaaataaaacaaaataaaagaaacaaatgtcaatgggaagcataagtactttttatagtaaataaggcaaaaggggaaaatgttggccgggcacggtggctcatgtctgtaatcccagcaccttgggagactgaggcgggtggatcacctgaggtcaggagttcgagaccagcctggccaacatgttgaaaccgcatccctactaaaaatacaaaaaaaaaaaaaaaaaaaaatagccaggaattgtggtgggtgcctgtaatcccagctactcagaaggctgaggcaggagaatcacttgaacccgggaagcggaggttgcagtgagccgagatctcaccactgcactccagcctgggcaacaatagtgaaactccatctcaaaaaaaaaaaaaaaaaaaaggttgggtgggaaagtttatagacagtgtaaaattgctgccttctttcttacatataacactgtcatcatcaaattgaagaaaccttattaaatatatttattctttcctttaacaaatattcattgaatcctaatggtgtgtcaagtactgtgctaagccttgccagtagacaagaacttgatgtgttctagatgttaaaagaagcccttattccaagataggccagcatatactattaaaaagttattgcatgaagtcagggtgtagacatatcgggggttaaacagacatgaaatatttacatgatatttcaagataatgttggtactctattaaacaaaatgaattatgatgacataagttaagaggagacttaagacagccttggatgtataaagaatttttgtgaaggaggtacagagaacttgcagagttttcttgtctgtaatgtaagactattatatttagaaaaggaacattgaaatttaaacaatgtaatgtttttagttcaaaagtatattaaaatacccaacactaatgagcatttagcataagtaaaacactattgtaaggactttacatatgttaacctacatgattctcgtaagaattttagaagatagatactattatttcccctgttttatagataaagaaactgacaccaagcatgtaatgtgcctaagatcatacagccagtaagtaagaaagccagaatttgagtccaggtatttgactccaaagcacacactccaccatactaaatacatggcatctatagtgatggttatttaactttcccagctggaaatagcattaagtgtttcaaatatccaaggaaccgtgtttttttttttttttttttttttttctgattgaaaatacaactggttataacatttgtttttttctggaagcagatagcctttgccatgccttccagttggcaccttgccccttgctaatatgcatggatgggtgccttttgctttgcagcctgccagtagaacgtgaccttggcagcccggtgtgccagccaagattccagaagagcgaaagtagctcttaacttcttgaagaaactctttgaatcaccaactatgccttgccatatctgtccacatggtactagtcctttcacaaggggctcccaagctaatgactctaattggggctcaactgtctctctaatacattctttccttaattttatgtttttctctggttggaatttcctaatgtctaaaatattccattctgtgttactcagcaacgatcttatttgcttgcaagcattgtggtgacaaacataataattaattatgtggaattttgtttagaaatatttttgttggaacagaaacaggaattctatatctgtacagtgactgaaatacaagggccctctctaaatgaattatgtgtttaaatgttcagattttatagtctatttaatcctgtaaatcttaataataaatttgatggcaagcagactgtgagtggaattttagataacaacatatgttcatagtgattcatgaaaatgtaatcctttatggtaaatctgtattatttataccaaatctttctctctggcctagaccgcttttttaaattccagacttcctacagatatatccatttagatcagggtttttgagatttgatgctgttaacattttggactggccagttctttgttgtggggtgccatccttcccattgcaggatgtttagcagcgtctctggcctctacgccctagatgccagtagcacaacactccactctgtggtgacaatcaaaaatgtcttcagaagttgccataagaccccggggcaataaaatcatctctattcacgaaccactgatctcgatgttctataggcttatgaaaaatgacatatacaaaattaaactcattttccccttagagcttctcctacagaggggttaggagcatatctgaagcaaactctgcctccctgctttgatagctgtggaacttgatcaaattaccaacttctctatacctcaatttcctcatctctaatataaataccttaataaaacctccttcatatgactgttaggaggattgaatgaactaatatgtataaaacatttaaagcagttcctggcacataggatgcctaagttaatatttgaataatcaattaatactattaaatgttagcaatagtcctacagtacaggaaaattctaagatttttctttgtatagaatatgtgcagatacttttttaaaaagattaataagtgacagtaaatacatgcaacaaagctcaacatcattaataatcaagaaaacacaaaataacatcatgatatataaatctattaaatttggaaatatttttaaaaatacttcatattaataagattgtggcaaaaggccctgtactgtactgatgggagaatatgtgtctgttttctttctggaggatcagttaccactatgtatcagagcattaaaatatttatagtctttcacagagttaatctagctctagaaatttatcctaagtgtgtaatatgttaaaaattaatgaagtatattaattactgttatttataatggcaaaattagaagctacctaaaatctcaataacgggaatgaagaaatagctcatggtatatttatgtcatgcaatatgtagatatcacattttacaaataataaattaggagaatgctccgactatggtaattcttagttcaaaatgcctccatcactttcaagataataatagaaatatttaagtgtgcattatcatgcacacataaacatacaccttttaaagttattttttgacagaccctgtgtatttatcgagtcattttttctctctaggtttccttccaaattctctacccacacaccttaagagattctgatacatcataaatagagggacatacatctttacatgaaaacgacatggaagattttctgagggacatgtgaatggtgaatttgcatgatgtggagacccaaaatggctgaggactgctgctcagtgccccagctctgttcactcgcctagagtttcctcaacaagccctgctgcttctgtcttctgagctctgacccaccaagccatttcctctacttggagtgctttccttccctttctgcttttcccttctcaaaaccaagctaaaacattgcctgctctatgaaacttatcctatcaccctgttcagatgcacatgcctttcttctctacttttgtgacaccacatgcagatctgttcatcatattttctggtattcatttgtttaaaaatatgaattgagataccactaaatgccagatgctatattaagtgctaactacagtcttggtgaacaaaaaggtaaaattttcctgctctcgtggggcctgcattcttatggaggagatggaatatattttttaaaacataaaatctaaatttattttgaggtgattttgatcagcacctcaaagaagcaagagggtgaacagcagtaatatctgagggacaagcattctaattatagggaacagcatatttaaaagtcctggactcgttcagtgtattttaggaaaaaaaaaaaaaaaagaaaagtggcttacaaggttgagactagcagaagtgcagcaagaaatgtgaccaggaagacaccaagatgctgtatgataaagtcctgaggccactgtaagatctttggattttaatttaagtgtgtagaataacatgatcttatttacgtagtaaaatactaagaggcaaccttctggctgctctgtaagaagggattgtaggacccaaagtgaaagcaggatggtcagctagaggctgtcatggtgatttagctaattgatgttgctggcttggatctaggtgacaacactggaggtggggagaagttatcagatttgaaggatattttgaaggtagagttgataaagatctcataggtttggtataggttaaagaaagctaagcctcaaggacaactctttaagttttgggcttcaataattggatggattttggtggcactttggtgaatgctgagtgaaggacatgtttaagaatgaaaacatgttaatagattctggctgtattattaggtgtgagatgccaaccaggcatcaatgtggagatgttgaagggacagtgtttaggaaaagggtcagaacagagatatgtatttgggcatcatcctcatatagatagtacttaaagttatgatgctgacatgcctaccagggctgtgagcatagtctgtgaagatacaagttctgaggtctgaactctgggacactccaccatttagggagcagaaagagagtctaacaacaacaacaaagatgagtatgagtggttaatgaattaagagaacaggaggatgtggactattagaaactaaggaaagacagtatttcaggaagggggagctgatcatctaggtcaaatacataaagaatttaccactggatttgcattgtggaggtcattgccaaatggctacctttgtcagagccatgatgctattccttggcaaatgttgacttacttatctgtttcttccaggaaacctgtgaacctcacataggagtgattttgccctccaggaaacctttggcgatatctggagacatttttggttgtcaaaactgagcggtggtggagtgatgctactggcatctaatggatggaggcacaggatgctgctgaacatcctgcaatgcacagagcagctcccccacaacaaaataatgatctggctccaaacgtcaatggttccaaagttgagaaatcctgcactaaacgtatggttcccaaagtgtgtgcttagacaccccagggtggacataggagtgccgtaggacattttaaagtgtgaatggaaacacagtggcatctgtcaagcactaaatgaactactaactcaagatagttcacagtttcaacattagctttctttttttttttttaaataatgtctctttgtaaaacttggttttggaagttgctgtgataagaatcaaatacttggtgaatatcactgtggaataagaagtgagaatggcagtttccaatctgacttcaaggtttgtgaagttgggtagtgaccagaagttgttgagtttttaggacgtaaatagttattaaattgtttggacttgacaactcaagaaactcaattattaggtatatcttttggcctagggggtgtagtaaaaaattatggatatgccacgggcaccataaagcagaaggcttgaaactgctgggcttgactttaagttccttgggaataggcattgtgtattagtactttatatctgcagcacccaaaacagtgcctgctacaagtgtgaggtgcgagaatgccaaacagatatccataaggagattgagggaaatttaataaatttaagaaataaaatggcaggtatgaaatgaatgaaagggcacatgtgcactgtagtgtcaagagaattatatgttaagtggcaaaattcgacctactggttcactatgcactacaacatccctaaatacctccctacttatataggataaaataagagaggggaaaagaataaagcttgactttcttattctttggcctgtgaatctctagactaaaatttcttgagtttggtgcaagtttacttcctcagattacattattttttcccaatacaaatttctattctcacttatattatgcatattgacaaaactgtgatcttattctgcaggaatatgtgaacgggagtaatttgaatatctcctaaatttttggctgcttttcttcctgccccttttgccaagcactacatgccctagcctaatgattgcatagatgttggaaagagatgttctttttagagttagtgattctattttgtttttgaaaaaaatcttttcagtgtaagaatatgatttcagaatataaacttgtggaaatattcttggtatagtggcaagaagtcagcttttagaatgggatatatagtcccatgcatctcactctcactgggtcacatctggatcaaggcataaggtttctttgactcttagatttgtcacctgtaaactcggaatacgaactctccaagttcttatgaggattagactagttagctgatgacaagtacctatcacagtgcttgacacaaggagatactcaataaattatagcttctccttatatttcaacctgacctatcctgacaccttctttctccttctcattctcttagtcttttgtttgactttaacacctaggatgaagcttatagaacttattaccattttaaaataggcaagttgtttgctttgttggtattttgtgttgtatagtgatggggtggtattttccctattaataatgtagtgcatcaacaaatgtaaatatattcatagaaagttctccagcagggacagagttggagaatcgctgagtcaccagtctcccctcacctgagagtgttcacagtgaaacttctctccgttgtgtgttttgtggccttgcttatttgcaatggtctgtcctgaagaatttgagattagagaccccgtggataatcatattccaaggtcaccagtaaaactaaatttctgtaatagttataacttctactaaatatttttgctagagcagctaaaatgcagtctgcctgtgaaatctggctgacttaccttattcagcctataaaagttatgtttactctacagtgtagtcatttaagtatgtaacagcattagcctaaaaactatacatactttaattaaaaattactttattgcttaaaattgctaatgatcatcttcactgagtcacaaccttttttgctggctgagggtcttgcctcaatgtcgatggctgctgaccaatcagggtggtggttgctgaaggatagggtgactctgacactttctttttttttctttgagacggagtctcgctctgttgcccaggctggagtgcagtggcacgatctccgctcactgcaagctctgcctcccgggttcaggccattctcctgcctcagcctcccgagtagctgggactacaggcacctgcaaccccgcccggctaatcttttgtatttttagtggagacggggtttcaccatgttagccaggacagtcttgatctcctgaccttgtgatctgccctcctcggcctcccaaagtgctgggattacaggcgtgagccaccatgcccggccgactgtggcactttcttaaaataagacaacaatgaagttggctgcatcgattgacttttcctttcatgaaagatttatctacagcaagtaatgctgatgtggtttcatagcatttgacctacactagaacttctttcaaaattgaagtcaatgcttctcaaaccctgcttctgctttatcagctaagtttatgtaatattctgaatcctttgtcatcatttccacagtgttcacagcatcttcaccaggagtagattccatttcaagaaaccccttccttccttccttccttccttccttccttccttccttccttccttcctaccctccctccctccctccctccctctctccctctctccctctctccctttctccctccctctctccctccctccatttgcattcacaattttgtggtttggttcaagaggccttgctctccacctgtcttggctgtcaacatgccttcctaactcagcttaatcatttctagctcttgattgaaagagagatgtgcaactctttctctttcacttgaacacttagaggccattgtagggttattaattgccctaatttcaatattcttgtgtctctgtgaatagggagacctgaggagaggcagagagtcagagactgactgctggtcagtgaagtcggaacaccacacacaacatttacagattaagttcgccgtcttatatgggtgtggttcgtggtgctccaaaacaattacactagtaacatcaaagatcactgattacagattaccctaacagatataataataatgaaaaaaaattgaactattgcaagaattacaaaaatttgatagagacataaagtgagcacatgctgctggaaaaatgacactgacacacttgctcaaagccgagttgccacaaaacatcaatttgtaagaggaaaaatatctacaaagcacaataaagcaaagcaaaataaaatgagatatgtctgtagttgtatctggtatgtaattagctcttggatttattgctttaataagtgtatgtgagtctattggtgtaaccttcactatgtaaaaaaagcaacacttttgtaacacatttatgacaaaggactcatatctaaaatgtataaataactcaacactcaacagtaaaataaacaaccagagcaataaggaaatgggcaaaaatattaaaagactgttcactgaggaggatatacaaatatcaagtaagcacacaaaaatgtaataaatatcagtgggtaaatatatatatctctatgataatagctggaattcaaattataatgtcaaatgctagtgaggatgtggataaattggagcgctcatacattggtattgggaatgtaaaatgatactgctattctggaaaatagtttggctgattctttaaagatataaaaaataggccaggtgtggtggctcatgcctgtaatctcagcactttgggaggccaaggcgggaggatcgcgaggtcaagagatcgagactatcctgaccaatatggtgaaaccccatctctactaaaaatacaaaaattagctgggtgtggtggtgcgtgcctgtagtcccagctactcaggaagctgaggcaggagaatcgcttggacctgggaggtgggggttgcagtgagctgagattgcaccactgcactccagcctggtgacagagcaagactctgtctgaaataaataaataaacaaacaaacaaatttaccatataagccagcaattgcacttctggaaatttgtcctacaaaaattaaaacttatgttcgcacagaatattgtgcacagttgttcactgcagctgttttcatttgaaataactcaaaacaataaacattcacagtgtccctcaatagctgaatagttaaacaaactgtgtggtacatccatgccatggaatactgcattgcaataaaaatgaatgtactgttgatacagacaacagcttggatggacctctagggcattatattgaaggaaaaaaagccaatttcaacagtttacatatggtatgcttcaatttattaacattttaaggatgttaacttcctgattttgatattgtactattattatataagatgtaaccattggggaaaactaggtgaagctttcacaggattcctctttgtactacttttgcaactctccaagaatctataattatttcaaaataaaaaggtggttttttttttttggtaaagtcatattttatgcacacgcacacccacacccacacatacacacagtttcttatggggaaatgttattttgaagtaaattgggaatgtaggcatttcatttattctttccaaaatcatttgtttctacttttgcaggattttttttcttcttcctcctctttctctcccttctccctagttcttttttttttgtaggatactgagatagcttacttttcttgcttaggaatgccttcattttttggaaaggcattctttattttttttttaccattttcaactcaattttagttatttaattttcctgtcattataatttggatatataacttctttgagaagtgcagatcatttcatagctatctcattctttataactcaatctttttgttttttaacagattagaacctaaagcagagaaagttagtgatagaaagcatgaagtagagtaacaaaactgaaaacagccagttgccctaccaacctgttctgctctattcttctattttttactgtactatattcgatcccatttttttcgttccattctatgttatgatttcccaacctatatgtattccattcatcctgttctgttccattctatgcaataaatatttaatgagtgtttagtatgtggcaggtgttagtctatgtggcttggcatgtaccagtcaacacaacagataaaaaaattgctgctcttctaaagcttacattacaagaggaggagacagaaacaaaacagacttaattcgtaagtaaattttagaagttagtgagtgctatggaataaagaaagagttaagtaggtgggggatatcaggtgggaatggagggaaagttacaattttcaaacagggtaaggtgtgagaaactgtaaggaattttgccataaattgatctgagcgatgcattttctgatcactaagaatagcaaggccaaaggcactaggatgtgagatgcctggaatgtttaagaaacagcagggagatcagagtggctggagtagagtggtgagaggagagtaggtgcaggtgaggtcagataggaaagaaagatctgactacaaagggcttttgaaggtgttggtttttactctgagcaaaatagtcagccatggcagggctttcagcagaagaccacatgatctcaattatagtttaggaccctagcaatcctgttgagaaagacattggcttattctatactcttagctgtgaaggtagagagaattattattcatattattaacaacaaccacatacatcaaaaaaccctcaggatattttgaagatagagtcaaagggatttcctgatgaatttaatacagattgtgagagaatggaaggggtaaaacatgattccaaggatttgggcatgagcatctggaaggttagtgttgccaacaaccaatatggagaagatggcatatggagcaggtttgagggggaatgtcaggagatctttttttagatatggtaactttgatatatcttttagacatacaagtagacattgcttgtaggcaggtgggtatatgagtctggagttcatgaaagagatccagggcagagatacatatctgagagttgccaacacatagtgatatttatcatgagattagatgaggttaccgaggaagtgactataggtggagaagaagaccaagaactaaaccccggggaaccagagttaagaagtcagggaatagacaaggaaccagaaaatgagacaagaagcaactagtgagatagaaaccctgacaatgtgtgtcctctcagccaaaagaagaataagtatcaaaagcgatccaattactaaactgtgtctcttacctcagtgcaaatgtgtatgatgtgattcaatatcttcctgtatccctaattttatttttattctatttttatactggaaaacaggatcattttttgtttgaaatttagcctgctaagaaaaagtagactttgttgttattgttgcttaagtttcaaacagaatcaacattgtttaaaattgttttaagaactagatttggtgttaacagtttttctgtggtgagtctgaatttccttgagccgttatttacagcagaaggtaaccactacacttattctaggaggctggattgaaatgtattttatgtattattatcttaggaaaaagatattaagcatcttatctttattatgatcacatttgttattatcagcatcttctatagatagtactttttgaggctacatgttattgtggacttgtgcatttttaaaagattaagcatttggcttggaattatcaagtaatcctgtgtagtaactgtgattaaaattatacaggaattcatttcaaactgtgacaaatatattgtagcttacactcttattgaatttgttcatatattttatcaagaatgtcaagtatttttacattaggtttatgtaggtttataggtggaaatataaattattagtaatgcaaattatgatcttgaaaaagtagctagattttcaggttttccttttttttgagcctgcagactatttggaaattaatttgcatttttttggtgtgtatttatattgtcttttgcttatattctgcattacaggattctgagtttccacttaatgagtaggctttacagtacccacaaattactgcaacaaagttaaaaaaaaaagcactagaagcctaatgaaatggactgctgagaacagagctgaataaacacaagcttccctttttgcagtgactgttccaaactaagcagaagctgcttctttatttcagggaaggaaaaataatgacccggttttctttatttttctggtgagcaatttaactgctacctccatttggcatattctcccacttcttttactggaatgggctataactgtaggtatggcattctttgccacaatgtatattttccttactgcagtgtatattttgagccatatttaccaacacagatatttactttttctctgagatgtggtctagaagcaattgttcagagagaaattcaacactgactctagaggtaaacctgtacccggcatttcagtgtgtatgtgtgtttgtagaattatcatcaaagagagaagattattcttccagatggcatttaccttaataaaaactgctaatatgcacaagcttgaaaaccatttctaatccaagtgtactggcagcgtgttattttcaggagtagttgcattaactctttgaaccttttaaaaaaattatcttctacttttgaactaggtcttttgaaagataatagctatcctaagtaagttatcctttgagtactgtgcgtgtgcacctttgtgtgtatttgtgctgtgcgtaaaccattgtgtattttggcatggcccaagtcagcaggaaggctccagggctgaggctgctttcatcctctgatacaccctcacaaccttcctgttttacgataattctgaaacctaacgctcctgctacttttaactcagaactgtgtttatttgcctgtggcctgttttattgtaaaataaaaaccttaagaaccctatgtttttagggtgcttttcccccctcaagaacactgtggttgtcttaaagcctaaatgactgtgttttaatgatgtgtaaagattcagtaaaaaataaatcatggcaattttgttttaagaagaaacttttaaaggcaatacgtgctgcagacttcaaaaagtctaatcaaacaattaagaacaaacagtacttgtgtgaacttatcattttattctgcacttttcataacatattaggtgttaagcttcgaaagattctgctttaattccgggtaactattggtaggggatttaagtcacaattatttaaacataagtttttcacagatcttgaatgtctctgggaattttctccccgaggcaaataatagagggaattaaagctgatttgttttctttgccaattgaaattatgagataggtggctgccactgattttatcttacctacgagcatcctacagccccttatgttctggtaatgcccctgatggtgatgcatagtaaatagtggagtaaattagaagagagttataggtgtgatgggagtaatggataagttaaatgccgtctttatcctcaagggacttacagtctggctcagtatttcttatgaagggagggtgggacactattggcattttaggtagggcagttcttttcttgtatggaaatgttccacacattgtaggaagttaagtttctctggctcctgcctagtaattattagtagcaccgttagttactgtgacagtaaaaaataagtccatatatttatcagatgtcctctagagaaggtattaattctaatccttcttccttagaacagttggaagatctgaaatatacactatatgcataagaagtgattatagaactgtattgtctatattgtcgaaactatgttaaaggaatgatgcataccataaaagcgaagaaaagacaggaaaaaaaaaggctggttagttgcctctgtgtacaccaactggtattacagatcactttttttttttttttttttttttttttgagacggagtctctgtcatcacccaggctggcgtgcagtggcgcgatctcggctcactgcaagctccacctcctgggttcacgccattctcctgcctcagcctccggagtagctgggactacaggcgcccgccaccacgcccggctaattttttgtatttttggtagagacggggtttcaccgtgttagccaggatggtctctatctcctaaccttgtgatccacctgcctcggcctcccaaagtgctgggattacaggcgtgagccaccgcgcccagcccagatcactcttgaagatcatgctgattcttctgctgtgactatcctcttctgtctccctccttcttttttttctgccctggataactcctacttaaccatcaagataaactaaattgttataccttccaagaagccctcatgagctttctctcttcttagactgggtgggatgactatgaacctggttcttacaaatcattgggtgcatctctgtcactgtcttctagaattctattgacatcatctgttaagggtcctttctatcttctcagtagcttctatgtgtatattgcaggcaggaactatatactacatctttcttacctagttaaattctatgtgtgaagtgcatattcaattaactgacctgaacttggcagaaacatataaaattgtgtagttgtatagttgatgaaaacatataaaatgtagtttcattattttttgacatcaaattaaaattctgttcaaaagtctcctttaatataactttgctcatttaaaaaagattcttatgccccactgttggaaatataatttggtacaatgcttttggaaagacatttggcagtaggtatcaagagatttacaagttcatggtatttgattcattaattccatttctgggaacctctcctaaggaaacaattctaattatagaaaaagcctgatactcaaaagtctgcatttcaaaactgttactaacagcaaaaaattccgaagtcttcaagaagtctggggaatgggagcttggttaattattgacaatccaattctaatggataattttgggacaattgtggggaattgtgtgtgaatatgatctggcttttagatgtgatgaaattattctgaaatagatggagattgttgaccccccaaaataatatagctacaatacaatatgactatattacctcattttagtatacacacggagacagacacaaacacacagatgtgtgtatatgaaaaagatccaagaggatatactggatcttagcaatgctaacatctgggtattaggaattggtgttgatattttctgtattttattatttcctaatttctacaatacccatttacagatgtaataataaacgatatttttaaaaaacaaggaatcgaaaataatttaaatgttcattagtaacatatggctaaattaattattgtaggtctgtattctaagttatttcattatattcaaagacaatatgagaaatttttataacatggcaaaatagttgtattgtagtattcagtgaaaagagcaagatgaaaacctttttacataggttggtctacactccaaaagtagatctcacagtgatttttttctacatggtaaaatcttgggattttctttttattttcttgaattatttttctttagtaaatatatctttttaattggaaaaataaatatatcatcaaaaattctgttaaaaatgttcatgcttcaaaagtttcaggttattgttggaggcagttcaaaaatgttatagctgtgaatcatggctgtatttaaatacaggtagcacttcgtgttagaaatatgtgttgggaggggtttatattgtgtgtttatgtaaagatagggtaagatttcacaaacttcttatagacaaaaacagttacaaagatttgtgtcattttagcataaaggtgagttccttaatattactttttattaaatcatttattcattccttcattcaataattatccattgagcaagggcttgggtgcccaagattcagaaataagaaatgtagtaggaaacaacacctaaaattgacttttctctcaccttttgggcaaaaattggaagacagttaaattcttttacgatagcagtatcctatgtgatcaaaaattcaaagcgtctttactatctaaataatgtctattgaattttcagatgttctctcagctctttaattaagttcactaatttctgtctcaatccagtgttgaagtcagcagccaaatgccacatatggaaaaatgttcctctggaagtaaattgaatattttaaaaattactgtcacttatcttaatatttaactcaataaaacttctgtttctcagtgtttccccacacattttcatgtgtctgttaaattgttggtaatgctgcatacataattccttggaaaactaaatggattctctatcatttagaagagttttgggggtaatgtggtaaatcattttttgagttgggtaaataattcttttgagtaattaagtaaatctaatgagtgctgtttaattgcttattggtttattcagtcttttatttgcttcctgtatggcaagttcagaaacctattaatattgctatttattgagagggcttcttaatatcttttaatgagaaaaatacctggtgacagtttattagggaattcagtagattcaagaggaatttttaaatgatctcatttgtattttagctataagttaggagacaaggttctgtgctcagattcccagctactgcaggaattgtatgattgtggttatttttaaagccagaagacgctcttttggagttctgttatttcaacaatctagatctattctccatgtgatattgacttaaaatttaaaaagcagatgtaggtcaaaggagattctgcaaacacttttgctgttttatcctggggctttgacaactttaaagcaatgatgagtttttttttttttttttatatctaaccttaatcctcctggtatactttaaagtcacctctccctaagttttctttattacaaatgtaaataaaaatgggattgttatgtgtgttctttattttagttatgttatctgtttcatctataatatatagagatataaacataatatttcatgaaagatagactttatggagaatacacagaatctgttactagggatttctactagtagtagtagtagaaggggtgagaaaagggaatttttgacctttttttctcttgtatggttaaaatgtcttgccatgaacattgcaaattatatattataaattacttttataatttaaaaatatattttatattgtaaaatattaacaattataatgatattaagtattataaattatttttataatttaaaacaaaaatgaaatattatttatatacaaattgttggtttgtattaggcttttggcatattaggggcttaataaatatttaattgaatttcagcatgtactaacatatatttttctttttacaagtgagcctactacctgctgaacttgaaagaatctagcatttaaaagttctttaacaatataggaaacctagaataaacaagcataaagactttaaacatttttaaaagctgtttaaagaatgttcttatattggttagcctttgggccccaaatacagaaagcatttattttcattttaaaaagggcccccaaacaagacagggctaataaaccagttataggatacagctttttttccatttagaactttatgcaatctgtcatcttctctgatccatcattattaatggttagtcttctcatgttttacatactttattcttagaatcctcagaaaacacactcatttttcctgctactaaaataaataaacattgcaatttattcctaaatatagtgtatttccggttattggtgtttctttcataggccattggtaagtgaaggaactacagagaaataaggggtaagaggaaataaaaatgctatctcaaggtctttgttctgccaaggtcatctaaaagctacacagcagggttcatttcaagactacatttcagggttagctcactaaatgtatccaccatactctacagatggggaaactcaggttgtgcttagcctaacatacttggttctgataatgcttggttctgataatgccaagatgataaatagatttagtccctctattgtaacatttgtattgaatatatgggttttgtaggataccaccagaaaaccaactttaattgctttctcttctacccattcaaactagcactgaaagagaagtctgactcactgaccaccacttgagcacgaacttttctggcaacattcagataattaaaagtcatcaaagcactttagcctcaaatggtctcgattcagtaattatcaatgtaatgacgttttcttcacagtaaaggtttctcagattcactagctcaaccagctgcatggatacacctgaaacagaaaagaatggcatggtcagctttgctgtttgccccagcttttgtgttccatagctgctttgccagcttgttaagagtggtgacattgggaagtgaggggaacaggtaaggcagggaaatgccttccatgttgggtgaggtgacatccctgttttggactgatgattaaagctgcctctttttctggtggatgcttacccagggttcactcatctacagttccctgaactaagtgaagcatcccccgactgacaagttacaacttgttcttcacactttggacattagtctgtacacctccagaatattccttctgaattccaactaggtgtccttcatgggcagattctaagacagcaaagcccaatagtcttgttctccctctctcccggcccagatctgacccacacaatacatacacacaccttcgtcctgctgattaggtgggtcatctttgcccaagtgtgttcaatcaccttcttatccttgatgtttatactttagatttctcaggcttgagtgagaaaccaatcgatcgtatctccaaaacttctggaaacatatcaatctctctaaatgaattctctgaagtcctttttactaatgttaaggtgagggacaagcaagcctgaaccatccctgaggaggagggggtagggacatggaagatactgacaactctctctcaagacattccccatctcttttttccatctctttgaccggttttactgcagcccttttatacgttggagtttaaggagctaaggcccctacactggtgttcagttattcccttttcagcctgcataggtggtctggaatgtgggagtagttgacacctactttcctggggtctcagccaaatgaaaataattatttagtaacagctttgggaatataactttttcacccttttctgtggtctctgagatactttttaatcctcaaatattatattctaaggtcttttaaaaatgtctgtatgttagaagcagtaatgctggctataccacctaaatataagtcttacactaaatgtgagtcaaattgacccaaatcctaaagtcttcctatatttgttttgattactcattcacttgaatagataatacatgacatgatatgaaagctaagataagcaaaagactatataatgaaaagtcttttcttctgttgtaaatcttagtcatgtttctctttccaagaggcaatttttttattatttttaagattcttatttcaaacatttctggagatctcaagattcatgtggagaatataaaaaataattgggctcagactgatctgacataatattaggtatatgttatctgtcagcagagagatattgagcatggaccataactgggctcactcctgctattctacctgtgagttagaaataatactaaagacctctaggagttgtgagaattaactgagaaaaatggatttaaaggaaatagtagtttctgttgtagaatattcactctatacatattaatttcttaaagtcccaacctctttgtgatgtcgtattagtttctgcttactccccaccctcaacactaaccattgtgctaccaacatcccctgtatgcctctgtgacagctgcttggtttcctgcatatactcacttccaaaaccttgttgtgtaaagtgtgcctgttgtgccccgtgctcatctctgacatagcacttcttcactacagtgtagtggaatatgcgtttttctcttcaacttagtgccttgttttgtcactcagcacagtgattggcacctagtaaacagtatgtatttgttggacgagtgagtgcacaaattaagcaccctcattaaaggcctgttctgttttgatagagggaacgtggacagaggtgaagcattttgatgtggggaattgtggggaccatagagctagctcccctggaatcagagagggagcattagcttggtagagagagagaatatgttaaggaaaaggcaaggggcaaagtcagaaggccatgaaggtcagataacacatctggaagtttgcttggacctcaccttgtcccgtgctctcctcctggcattaggaaatgactatcttattaagacactggcgcctttgaaggataccaccgatattcttacatactgtatcagtcagccccagaaagcctttggtgtcaggggataaaaagaaacaacaacaaaaaaatgaatcatttttctctcactttcaagtgattagaatagaagaaatagaaagatccattgccttgattaaaagaagtcagttatttgtggtggcattttaagtggatgctttcgcatgtgcttctccaaaagaagctggtaatagtatgtattgaatttaaatgtaacctgaacggctagagtgagcacactaatatggcattggcaacttcactgagcatactttaaaaattctaaaggaatatgccaattccccagagattatcttcatttctgaatgaagaaatattttgttctgtatattaaccttttgttatgcctagagctcagtatatctaaacaatttaattagattattttaactgctttattgagataacatgaaattcacccatttaaaatgtacaattgagtatattttagtctattcacatggttgtgcaaccatcaccacaatctaacatagaatactttttaccctttaaaagaaaccccagacccattagcatcaattcccattctcttttccatactaccagccataattaatcactaatctatttttttatctctataaatgtgcccattttttggacatttgatataaatgaaacgataccaaatatgtggtcgcttctgactgccttcctttactcagcatggtttcaaggtttacccatattgtagcatgtaactcagtacttgtttttattattgctgaataatactccattgtttcgatataccacattttatttatcagtgaatcagcagatgtgtatttggattgtttcgccttttggctactatgaagaatactgctaagagcattcatgtacaagttttcgtgtggatgtctttttgtttgcatatatctagcagtggagttttgctggctcgtaagtacttgccaacacttcttataatacatctttttgattatagccattctagtgcatgtgaagtggtatcttatttcagttttgatttgcattgccctgaagactaaaaatgttgagtgattttcaaggacttattggctatttgtatatcttctctggagaaatgtcttttcaagttctttgtctgttttttaattgggtcatttttattttgattattgagtcgtaagattttattttatacactctgagtattaaagatatatagtttgcaataattttcttccattctgtggattgatggtattattttcagcaacaattttaattttgatgtagtccaatttatgtgtttttctcttattgcttctgcttctgattttgttacctaataaaccatagcttaatccaaagtcacaaagatttactcacgtattttcttgtagttttaactcttaacattttaatacgtgatccattttgaggttttctgtgtgtatgtgattagttgtcccagcaccatttgttgaaaaactgttattttccccattgaaataacattcttgtctaaaattgattaaccataaatgtaatggtttctttctggattctaatttctataccattcatctgtacatctgtccttctgccagtacttctttgttgtattattataactttgtaataagttttgagattggaaagtgtgagtcctctatattgttcttccattctaaggttattttagctatactgggtctcttccatttccatattaactttaagattagtatgtcaattgccaggaaaaaagatggaattttggtagggatttcatggaatttgtggatgaatttgggtcatattgctatcttaataatattaaatatttaacctatgaaaatgaaatgtttttcattcgtttagatctcctttaatttccttccatacagtgttgtaatttcgatgtacaaggtttgcacttttgttaaatttatgcccaacaattttgttcttcttgatgtaggtcatgttttattgattagttatttattttggttgtatttactgatcaaattttccaagatttcataaatatattatgatatattttgacagaaaacttttgtgatggctaagaaaggtttattccatttatgtgctcccatttttgctctcaaatgatgttgcccactgactttaaaattaatttcaaaaagttcaatgtggccgtaatagtgctattataatctcagtatatcagtgatttttaaaaacggatttctacttgttttatacaattggtcttcaaatcctgctattataccttgaaaatgtctctcaaagtcatctttttttttccatcctgtgttaagcatttgaaatataaaatatataagcctcctccaaaaatatataagctccagttattcaatggttatgtttttgttatcttcttttgttgttattgttagcttattttagttatttccccattttccatcccctaatatcttttactcagaaaattttcttataacccctacaggcagaattaatttttcctgtttctgtgattacacaatgtatttaaggtgtttagcacaatattcgttatagagaatagtctcaaaacatggcacctgtcaccatctctagttatctattcaaatcatcagtatttgcccatatcatactctatatctttggtatgttttcttgccatcaattccctcagaaccacccaaccccccccatgaacttagattatttttttttattatactttaagttctagggtacatgtgcacaacatgcaggtttgttacataggtatacatgtaccatgttgatttgctgcttttttttttttttttgagacggattcttgctgtgtctccaggctggagtgcaatgccacaatcttggctgactgcaaccctgctgtcctaggttcaagcaattctcctgccttagcctccaaaatagctgggactacaggtgtgtgccaccacgcccagctaattgtttgtatttttagtagagacaggatttcaccatgttggccaggatggtctcgagctcctgacctcatgatccgcccgccccggcctcccaaagtgctgggattacaggtgtgagccaccgcactcggccagattgtaaattttttgacaacaatgactattctcctcatctttctatgttcaaggcctgcatagtttagaaacaaggaaacagtacagttgcaaccatacaattgaaaaaaaaaaattgtccatggctataaattaattaatctgtcctgattttatgtctgtcaaattataggtagtactaacccagtaagagctttattgataaataaatgagaaattacagttttatcaagtgtgaggtaatccctttttttggggcttgcttatttctattaagcttccaagtattttttaaaagacaatttgtattcctggctttattttacagtttggttttatctattctatttgcatactgagaggaagctggtatatagcagtctaagctaaatgaaaaataagtgcgcaattctaatattcaaaaacaggatagaagatgtccatttttatttttttattctaaataggaataatatgcactataatgtttatatttcttccaagtatcttgtaccacatgcttatgattgacattgggcctctatacctattccttttcgttaagagactacttttgtattaacattttaccattagattttattgaaacactattcaaagtcctcaaaatttcaattttatacctttttatttttctgtaagatgaagcaatgtctttagaatgttattttaagctcatctttgggcttccactgtttcctctacttgcccttattttaaactggaaaatccatgaatgtaatgaccacatcttaggctctttcatatttcaaatgcctaagccagcatcaaataaatgtattttatttatttatttatttatttatttatttatttatttatttatttattattttgaggcggagtttcactcttgttgcccaggctggagtgcagtggcacaatttggctcaccgcaacctctgcctcccgggttcaagggattctcctgccttggccttccgagtagcttggattacagccatgcgccaccacacccagctaattttgtatttttagtacagacggggtttctccacgttggtcaggctgatctcaaactgccaacctcaggtggtccgcccgcctcagcctcccaaagtgttgggattacaggcgtgagccactgtgctcagccaaataaatgtattttttaaaaaatatcccatggtttgtttatcatataatgtaaaatcaagaatccaaatatttttcaaagggtagagaatttctgtgagtaattttttcctcagcatcttaatatccaaactctacttgctcacaagattacttaatcagcatcatatcagagacagcttgctgtgtttaccattgttagttgggccagcatatgtccaaaacagttggaatgagaaaaacagccttgacttgaagccaaattagagagggaggaggagaagagttctttagctgttgaacaggactacatattttggacagtgtagggtacttctgtagaaaaaaagaaaaaaaagggtggggaattctttcagccaaaaaacaaaggtgcattttgaaatatctaaatgcactgaaataataaaagcaaattggtgatgttgttttaattttatttatataagcctttgcaagtaatgaaatctttttatgttaaccaaaaaaagaaagaaagaaagaaaagtattctaagatatttataatgtggataatttttttttttttcagttttaccctggcaactttaattggcttagtggtttctaattctgggcaattttctgtttctttattaagcaatgtgggagctgttgaataaccatcacatttcataggatcagaataatatttctgatttttctcaaactgggtattatattactgtatagtaaaaactttttaagtgaggaaaatgtctattcttgttttgctaagtaacattacaaaaagtagatatttttgtgcattccacccccttaagaagcaactattgtagaaagtggtgttttcattgagagagaaaatggaaagtaatattttgctatttattatggaaagttagaggagaggtttccaaataccacaatcaaggaataaaacaattttgaccacaactgaattttatatatcaggcaaagcctgtcctagggtagtttttaattagataaagctttcttcagagttcctgctttcaattctctatcatttcttatctggtagggatcccgcttgcttcctagtacctctccctttctttacatcagaatctattatgtatggtggttattgatttacccaaagaagtcaatgaaggccaacagcagttgccttttgcatgagatatactttctgataaagactaaaaaagtaaatcacacacacatacacacaatttttaggtggggagggaatagctttggcagtagaggaagccttgggaatcactgttttacctccctggttttatttgttttatacatgagaaacccaggatccatagacgtggactaatcaagactagaactggagacgcagtgttctttctgccaaattctgtttctttacattgacaaggtattgggcattagcaagcaattgagagtagactgatagagatgttaatttattcattacttgttctttaaaacaactgtatcccatgcttgtgagaatcaagcaagatgacaaaggtttgttaccaacgagtttggtaaagcattttcagaggagtgtagtggatgtagtaggtttgtactctaggacctggaggtgagagaagacagaggaaggatgtaccataccgtatgttcagaatcaaaccttccctcaggtcctgaggttatcaggtcaagtgtgtcgcaaggcctagcttcctctttgctaaagatgagtttttcttaggtggtgccttagtcattcatgcaaatagacatctgcagtgccagccccacctgctctccagacatgcccagtagtttttgaaccttggctttgagtatgtcctgcagcatgccaaatttatctcgaggggaataagcccaagtgaaccgcctacgtaaatctaaccaagacaggcctgatgtggcgggttgaatttctatgttgaactaaggaatcgcatggggttctatggctatacttctcccccctaactgggcaaggcgaggaaacctgaataacaacccctatacaagagcatttaccttagcatagagacaaattgcactgtttgttgttctctcatttcttttgtttaaccatgataatacttacctttttagcttcaagatttataaattccaagcaattcatttaaagcatttttttaaaagcttgaacttaaaattttgtataatgtgttctctagctactgaatattctactggtctaatctaagttatattataaattttgtggaaaataagcagaagccatttgattcagaatgcctttgctaagctctatgattagcaatgtatttcctatgattttgggttatataaatttaaatttgcattaatatctggaacaacatttgggtaaatatttttcccatagtttttaaacaatacctaactaccagaactatcttgcatgaagcacaaaatttctgtagtggtttgactacagatctattactagggtgatagccaaacttgtagtattattattgcagctttgaggtgtataagatgtttctttaaaacctcaaggttttaaaacattcagaataaactatatcaacccacacattaacaaacatttaaatgtcaaataagcagaatatcctttaatttctaaccatccctttgcaaaacccattccaatgttggtttctataaaatatactggggccttgttagtttatacatacaggatatatgtatatgtatatatatatatatatatatatatatgtaagcttagaattatgtagcaactgctgcacagattggaacagtctatgtatgtctttcgctataatttattaaaagaaatttcaattcaataagtatttgttctatttgtagcttattgaagggtatacaatctctgtctcatggaaaaagagataatttaggagaacactcctgaatcttttactatggaatattatacaggatctttcattaggaccattctaaattaatatttaccatattattaaatatgcaagataaaaaacactgaaaaataatattgtatatgtgacaatggcaaagctaactgtaacctgtctagtgctcattattctcgtctgtgaaatggggataatagtaaagctgtgtattcaaagagaaagtccatccaaaagtcatagctagcgctcagcatatgttgctcattttaaagtgccatcattcttatttatatttttgttttccagttgactgcgtattgtgaagagcaagcaacaaagtctaaaattagtatatcaatctagtgaaaatacttagaacttgttttatatggtgttctcctgtcatgttctatttcctaattatgttttattttagatgaaatacactatgataatttttaacctaattcattcaaccattatagcagagaggtagcttggaaatttgtttgtcacagggacatcccaccatgtgagaataaaaattgggccgggcgcagtggctcacacctgtaatcccagaactttgggaggccgaggcgggtggatcacctgaggttgggagttcgagaccagcctgaccaatatagagaaacctcctctctactaaaaatacaaaattagctgggcgtggtggcacatacctgtaataccagctactcaggaggctgaggcaggagaatcgcttgaacccgggaggcgaaagttgcaatgagccgagatcacgccattgcactccagcctgggcaacaagagcaaaattctgtctcaaaaaaataaataaataaataaaataaaataaaatttggctatagattgattctcaggagttcgcaaactttctgttaggggcagataataaatatttgagattttgcagcctgtactatctctgtggcattcaattctgactttttagtgcaaaagcagctatacacagtaagtcaatgaatgagagtggctgtgttccaattaattttatttgtaaacactgaaatttgaatttcatatatttttatgtcacaaaatattttcctttaaaaaattgttttcccaaccattaaaaatgtaacaatcattcttaggttgcaggccataaaaaattaggcaggctggatttgacccatgagccacagtttcctaactcctgttctgcatagttaccttcattataaatattttcaataatttcttatacttttgattgtacaaagaggtatggcttcaaattacagactgatatctcagagctgtgcttaaagtattgagaagcattctgtaatgctgatggttttctcaatattggctaattctataaacagatactatgagttctgccagaaatagaaattctaatgacagtctaattaaatagaagccatggagaagaattattacattttcttatgccaaattataaatgtcttcaattaatgcacagatatttatttatttatgtatatgtaaaaagtggattttctgacagcctcaggctcctctttgtggtagaaccttctgtttctctaattagttgtgccttaatggccagtaattgtcttttataatgcacagggaacctaaaaaaaaactgaaggaaaaaaaatagaccatcacagtctatcttttcaaatcttttctcatgctgtcaaaaaacagctgcctcttactttttgttactactttcttcaattaaaaagtaatctcaaaatttatgaataatacacccaaacctcattaacactgtttacagttaattatgatttagtatctctctctgtctgatataacccaatgggatttagttaatcaagtaccgaagatgacttcattaccaggcagtctttacctgtgaatcagtagattcacagattggagagtacagccatagtgaatttaagaaaaacaaaaacaaaaacaaaaaaaaatgctaattgcctagactcaatagaattttgtatagctaaaagaaaagggtgaaatattaaatttggaattcttaagtacagaattgttccttaaaaagagtgctgaaatacacactttaagaaagatgctttagacttacctgaaaatacacaagtgtgtcaaaatatgaagaaatatattcaattacacatatctctgtggaatatattgacaattatgaacaaatgtttttcttcacctttaaaaacaaaaatatgtaatattattttaacaaaaacttttcagtctcatctgtatcaaggcatactccagaatgaaatgtgtagaaataaaatgaaatgcctattttgtagaagtcaaatagaatcagaatggagtggttgagatcatggactctggagctggacggtgtgtgttctaattcctgttgtacctgttagtgggtgtgtgaccttggccaagctcctctgtggcctccattttcctcatttgtaagtaagaatcccaagcacgtctactccataggttactagatattgcaacctcataatgttgtaaagaacaaatgaatgaatatttactttataaagcattcagaacgatgtttgttatacagtaagtgctgtaattagtgttggttccataatttaaattagaataagagaaactcgggagactggccaaaattatgctgttactctttgtgcttacccatgtttgtaaagccaaacttggaatcagtacatttagggaagtcacattttattagaatgcttaggacctcaaaactcacctattttaaaactcacatatccaaagtgcttcctgacaaaggatactggatatttctctttaggagcaaaagtggtgccaccatgtggcaataacataaatatagctgccaatccatttagcttggcaaggcttatatgagcacattacatgaatttttaaaatgttttaacgttcaatttttttctaaattgtatgtacaaagtataactttattatttttaattcagcattttaaaattcccataatttcagttctcataaaacaagagtggcattttctttgaaaaaacagtaatgtaatttgcctgtgatttgaatttggcaaaataaacaaataatgcccttataacactgattttcaaactgagttccatggagcctgcattccctgggggaaaggaatagcggaggaagtgagtggatagaaccttggttcctcctctccgtcttttctaaaacatttccacttttgctggttttatatgttggaactgttcgtaagattttatttgaagaaaataagaaaatatccagccgtttaaagaaatgtttttcttttctaaaagccagtgcagtcctatattaggagtttcagtggggctttaaaactttattttattttttattttttatttttttttttggtaataaagatttactcagaactagaaaacagctaaattctggagaagaggtaagatgcattggttgaaaccctattcctgttatgcaggactgaaaagattagagcagagaaaaggcaaagacatggtctgaatcgcagaagaaaagaaggaaggtatatcacacatggcatttcagctttgtttctcctacttttcccgcatattttcatgtatgttgttgtcttaaacatattaagcattgaggctttcagaaaatattcaactgttttgtgctggctaaaggtaattgtttcctggtggcaggaggcatgaaccaatgaaacttttttttttttttctgtcaaaatagcacataatgatgtactttttgtaagcaagaattcctgatagaagagtgggaacacatttttgaaaaagtttatttgctgagtaatatgtttagaaagaatgttgttagagaaggatatttgctaagaaaaatcatttattcaactaatatttattaaacttacagtataagctacataatatactaggttccggagttataagggaatcccttgcctcaaatattagggtttcataatgagagggaagttttgttagtcatttgaaatagctatttgaaatagtcaaatttgaaatttgactattttgtcatattcataaatatgtcatattcacaaatatgactatttgtcatattcaaatatgacaaatagctatttcaaatgactaacaaaacttccctctcattatgaaaccctatatttgaggcagaggatttccttataactccaagtatttgtctgtgacctagaagaatatataagttgtagaaaaaaatacgggaaaggggacggtttgcaccatcttcctcgtagttcctttagaagtgaatttactttagatcccagaggaagagtattagatctggccacagaagtaactcttttatattattacctatattttctattttaaaacattaaaattttgaatcttctcaagatttcatttttaggtacatttatatcaaattgaattttaatctcaaattacaaaataatatggattacaaactaatatataggttcttagcttctattaccttggagtcccataaattggcttgattttgtttccgtagtgcaaggagctgaataaagcttttactcagttcttaaatagtaaagaactagcaaacattgcgatactttagaactaagtggccattacagattagttagcagttcatgtttgtgttatggtttgttatgactgcttaattcaaaagcatatttgcagacagggagtttggattaagtaaatcaaaatagtaaaggctttgattaagaagttagcttgctttaacttaaatgttgatatttcaaggcctactgatattttagtcatttgcggttatttttgtttcctgttcagacccctgggaaataagagaatagtaaatcaaagcccaggttgctttttgcatttttttccttttcatttatgccatgtagtagttgactttaagaaactaaagacatggataacttgaacagaatcactgtgagggagaattgtatttctggattaatcaatttaaataattcttgttataaaatgattcttttcatgtttgataatttagtaattctttttattccacgataatgttatcgtaactagtggaaaagcagctaaaaatatctgcattactaaagtccaatttgggcagtattgttatcaaactgaggctatgttgtttgtgtctagggatcgctagggcgttgcttcatcagccagaaacctctgtgacaggtggtgccttctgcctgagtattgctagtgcccgtttctttccacccactcggctcaacaggctgcactcggctcgtgctgccagcccagaacccacacctgccaagtacgagcaaggcgtggagcggtgaggggtgtgtgtgtgattgagtgcagggtctagccactgcacacagctgggcacactggctgctgtggtggggcaggcagctccaggcaacaacacaggtgccagctccatgtgaggaggctgaggctggagcacatgtactgcacgcggcttctgctatgggcatccgtgtctggatgaggggaacatggtggcacccagaagcttggagatgcctggaaccactgaaccccaaagagagtgtcacagccccctggctcagggagcccctgggcctgggctccccaaagggccacagctcttctccccttctcatcgcccacaacatggcaagcgggagggtgtgtttcagccctgttcgtgttaacagctcttttagtcccaccatttgatgtgtcccgagttcttgtttcatacccaggaagaatgaggtatgcggacagctggaggctgagcaaagcgaagaggagcttcactgattggcagaacagttctcaagagacccaaagtgggcagctcctttctgcaagcaggtcatcctgacgagtgtccagctctcagtggagaggagacccacagtggttagctcctttctccaggcaggtcatcccaacacgtgtccagctttcagtggagaggagacccacagtgggtagctccttcccccagtcagtagtccagacatctgtgcagccctcagtggagaggtgacctagaacgggtagcttctatcggcaagcaggtcgtcccatcctctgcctcagtctggctgagtccagggtcgttatgcgcttcagaggaggggaagtatgtgctaattggtccatggacggccatgggtgggcctggataaagcaccataagttctcactctggtccacggaactgacagcctggcccccaggattttggctgtccctggcttgaaggtggggcttcaccaggtaccctcccctttctgcccaggagcttgtctgcctcctgccgccatcagtcatgttgttcacggttcccaggctgttgccgaagggcgcctgcaggcccctgttgagctgccctcaatctcccactcatgctctttggtgcccaagtccaaaggaggccaagacgacagggggctggcgtgtcagtgctgccctgagcatgcacatacccagccgggttgcgacagtgcctgggcttggcctgaactttgcttcaaaatcagagcgagtgctgggagcatggagaggccaggcagcgacagcaggcacttccaagcctgtggggagcagaggacctaccaggtccccgactgtgcgcagggatgcctgggtccatagctgcagctgcaccccggagggtggggcttctgcccctcaactcgaaagcgggtgaggctcccgcctgttcccagctcctgcgggctccatggagtgggcagcccccgcccccactgcagctggtgtcatggcagcagcccttctggacaggccagccactgccatcacatgttttcccattttctatttttggtgatagcaaattcaaacttcttaatttacttttcctgaaaaaagttgcctttcaagactacacattttaatgaagagccttcagtaataagcatttcagcatgtctcaaaaaagattcaactgttggttattttagctaaaatgtcaaggaattttgattaactttaaaaggatttaccttttatatttacatttattaatttaatttttatctttaaaatggaagatttgaaaaaaaatcttagcttagcttgcagcttaccagttctggtgtaattttcagtaatataacatggagtattcaatcatgaattagccattattatttaaataattcacggtgtgacctatactgggttatccctactgaagcaaacagcatgaatgggtaagttttattttcctcagtgttcacttactccatgttgtcacgtgtcagcacattgaattttaagagatacagtggagtctaggaaatgcaaaatgacaccttgggtggaaaaacttttcagattgttttcaaatacttacgcagtgttgccagaaatgtgttaacttagaaatttaactagtaaaacagcatatatttgtaattcaaacagtcaaaaagcccagtaagtaattgctttaggattttaatcgggtatgtgtgtatgtgaacatatacatgcagatgtgcacatgtgttactaattttattcccataatcttgtgactattattcattcattcattcattcacaccacacatgcactgaggccttactatgttttcatgttgtactaagcactgaaaacatagtctctgccctcatgaaatttggaatagtggtaaagatagacaaatgaatgttatgaaaagaactgagaaatttaatgggaaaattaaataaaactcagaaaaacatctatattaaatcatgttttagctaagatatgaaggataggactaatctagagaaatgtgttggtattgggggaaaggttttaggaagagagaacacatatggaaaatctctgagaccctggagtgcataacatgtttaaggaactgaaaaatcagtgtggcttgagtgagtggaggacaggtattattgaggctggaaatatacagagaaagcacactatggagaaacaggccagccatgttagagacggaggctccactgatgagtgttagccaggaacgtaacagaagtgctttaataaaacaggcagcagtggcagagagaccttgatggcttcaaaaactatttaggagtaggggccagtcgggctgactcatccctgtaatcccagcactttgggaggcagaggtgggaggatcacttgaggtcaggagttcaaaaccagcttggcaaatgtagtaaaaccccatctccactaaaaatacaaaaattagccaggcatgctggtgcacacctgtagtcccagctactcgggaggctgatgcaggagaatgacttaaacccggcaggcagaggttgcagtgagccgagatcgcgccactgcactccagctgtcagagtgagacttcatgtcaaaaaaaaaaaaaaaaatcaggagtaggaaagataatttctatcaattagataataaaagagagaggagtcactatcacttctctgtttctcttgtgtctgcaatgataaaaaaaaatacagggatactggagaaaagaacagtaagagacagctaaagagaatcccagtagtacctgtacatatgagttgcacatttggtggaatagatgtttaagctggagatagaattgtcaacatagaggaagcaaagccctaggaatggaagggatctgcagtgagagagaaaaagagagagagagagagactcttttccattagtttcccattccatgacatacttccaccagacataaactgttccttcatgcctttattctactttaaatcatttgatgtcagtatgtcaattagcattcacagaataagataagggaaactttttttagtctcatttacatctcacaactaaataggccagattttgtaagggaataaactcagaggctgctgaggggttgaataacttgtctctctgacagtggtggccatggcttctgccacactgcttgttttgtgaaacaaccaagtctcctgcctacctttctgacctttcattccacctgtgccttgtagagtccaatcacaagtcatttgcagtttcctttttcttttcctgttcctgtgtacatgctcttctgctctgagttcacgtctctgtgtttttggtggcatagggagggttaggcaaacatgctttctttgtgaagccttttctgactcgacctgaaataatcagtggtttctctttttcaaaatttctctgtaacaaataacataggacattatttttcagttggatgcctgtctcatgcctttctcctattctcagaacctgattaccttgccctaccctgcccaaccccattttatatgtactttatgtgagctttggcaagcagggaccacattatactttttatttttatttccattgtatttagcagagtaatagcatatgctcaaaaaatgtttgttgaattaagttgataaagaaggaagacatgggcaagaaacatagtgtaaaaggcaggaaggaaactatgtgttaagagacagtggtttagccccccaaaaaggtagcaagagataagtctagagaggtgtcggtgaaactcgtctgtggtaaaatttgttggggcaaacagtatttatgaaacccaatccataatacataacatggatagaaagaatgagactgaaaaaaaggacttgttaaaaaaaatttaaaaaccttggcagctgtcccctctccccaaaacacacacatcctccccactcacgcccccacttctgcctccacctccatctctatctccatccccaccagcttagcttgacttttgggagctagaatcccaaagatccctttcccagagtgctctgctccagacctagcagctgcagggaactgtgggtattttatgattttggagccagagaaacaagatggtgagtgacctccacaaactgagggaaaatgtttgggctttggctgggcttcttctgagcagtagtgcagccctaattcattcttctcttttccacacaatgacatcgaaggtgttttggcctgctattcgtaacgaccccttcacacatgttagcctgcggaaagaagctctactgagcagaggcgatcagctttccccaggtggattttgggccatgttacccaaagaaaacttctgttttctgttttgtgtcactcttctcagtagctttgctctgtaggccagccctggaggccccttctctgcagagggttagaggcctgtccccagtccctcatcatcatatttcaggatggctggaagcagtggttccaaggccaaattcatcatcagtgggaaatacaaactggtatggaagatcacatctggcttttttggggacatttatcaggcaaagaacataaccaatagtaaagaagtggcgctagcatccttgaattctggaaagctaggtatttctcattgcagtcccagagaaaactttttagattcttcagggcgggttagtatttcaacatgagatggtatgattagagcaaagactgcaatgtgctactcttggatcttcagccctcaagacctcttcattttcttttggagaaggctcccagtgaaaaccgtagttaggttagcagaccagatgactggtagaattgcatatgtgcatgcaaagaatttgagtcacagtttaaaccagataacttcctaatcagtattgagtattgctataggaagttattccttattgattttgatttgctgaaaaagtacagaaacaataggataaggcagcacatatcatagaggagatagtaatctctagcaccacttgctaagttagcatcagtgcacatcttggtattgatcagagttttagagatgacatgttatcatcatgatacatgtaaatgtaatttaatagaaccagcctgccatggcaaagattaaagtctgcaacaaagaacagaaaaatgaaaatgttaatgagagaatgataaaatgaaaaggagttgatggaaggtatctactcctgttgaaattttgtataaggggttttctgcagaatttgcagtaaactattgttatggatcacacattaaggaagccttgagacagctattccacaatattttctggaccctgaactgctgatattaaatacatatttggttgaatattgttaaagcagaaaacagtacagaaggcagcctcttcccatggagttagcatgcccaaactctcacaggtttccatgcatgaagggaggaacagaagaagcagaatagataatcagagtaacatttgtatatcgccaaatccagaatttttagttcatatgtcgcattgccagtgttgtgaacaaccatttcccaggtaaaaataacgtaggaataaaatggctctgggcagcattgctgatataaccaagttgtggcctctgtaattatgtatattaactgaagttgttaaacatgctttcaatttttatagcacctttttcagtggaaaacttaactaaataattggcatataccaatttgtgttgagagtttttccatgcctgtgtgtgtgtgtgtgtatgtgtgtgtgtgaaaacctattattttgaactctactgctttgagaagggccatatggttgtatatgcacaaaattgcgcattcttaaagttttttcatacgtaaggcttgcaagttgtttacttaaaacattaaaatggttggcatcttgcttaaggcagctgataaagtagcaacgaaagagtccggtttttgaacatatgaaaattctgtttgttatactatgaatagcagcatctaaagtgaagaagtaagaaatactctgtggtaactagattatccttagtactctgaatgaactctttaacgacccttgaattaaaaaatatttgttacagaaattgaaagctaaacgtgaatgttcatgttcatgctcaaataaatgtaattattatgaacacctacatgatttgggattttggttttattttgaaatgagagctctttcatttacaagttcactaaaaactcaaatgtttcttgaaaatcacaggagcttatgaacattaaaaagaaggaataactattgaacaaataagacagacactgtcaagaacgggcaggactttgcaaggtgataattaagactagttaatatttatgtggaaaagttctgactgggcatttggaacataataatatgaacaatataatataataaatatagcatacatttgcatttatttgcaacctcagacaagcaagatgagtccaaataaagctagcttcatcgtagtcctttcttacatgtgtcacaaggtcttgagatcagtttaaaaaacatgttttatttacaactaatgtgaatactaatatttgctgtcatcagattccttcgaaaataacatatgcatcactggccacctgttctaagtaatttttgaggaatttgcatgttcccagacaaggaatgttgtgaacagagatgattctatttatccactgttaaaaatggcagttaatttttccttgtaagttgatttctaattatgataatatggcagctatggacaatgccctttcttaaacatactgggatgtaaaagtgaccataacttgttgaaactcagtcctggtattgtgttactattatttctcctggggaggcttattagcctgtcacaaaagatgtaagaaaaatccaacattccttttggaatatgatgagcctttgtcacccacaatgcaattaatgttaaaaatagaaagaatggctatgatatgattatgattaggcagagatgagctattgtccaagtaacaggaactaatctagcaggccaaagatgacctacacagaaccatcagtgtgctgattgccatttctctctgagtttgatgaaatattcatgcctttgctctcctctctgcaagcactattgatttcttgtataaacgctgctatatttagtctagacaaatggaatgtggattgctgctgaataaattggatgaaagactgggatcttgcctgccactttctctcagtcttgggcaattatttataatcaagagcagtttttgtaagttgagggtgatttttcacaatttagtgattagtctctgaacaaaggcaagcagttagacgcaatcatttctgttgggatagcaggttaagaagtcaaattaccctttgaggtttacaataactgtttcagagacttgtaggactttttttcttatctttttaaaaaagcttttttagaggtttgatgtttgtagttcatggataacaagaatgccagcaagaagagactccagggtctcttgaatttttacattttgtctttatagggttaagttctgacctttgttttttgagatttccatgtaaaagctgaaggctatagcttggcctttttaatgtaaaaatgaaatatatcattaactgccattgcttttggttggaattatgccaagtcttttagttaatattcaaaatctcatgttactccagagccttgactaaaagttctacattgggtgctacaattaagagatcttacaggccatcattctaatttgcatctgaacttgtcatgattaatttctttcctttcacaaatatcatctttgagaagtcaatgtccaccaaactatagttcatttataaattattttcccattttcattaaagtgacacataaagtaccatcaatgcaaacttctggtcaatccatggcaaaataaccaatgtaagcaacccaagattgatatcagtctgcatgcacaggcacaggcacatgcacatggacattcaactcagatgaccagcaaggacatttaagtatatgaagccttaacatctgtagacaggatttctgttagcctttttttactcactgaaaataactcttaaattcacatggaaaattaactttgtagttcccaaactggaatctgcaaatttaagttagttacttatagtaatagagcattagatgcaatttggaaaaatacagaaaagtaaagggagaatcattcatatttccgtctaaaatacagccatcttctgttctctacatcaccagtcattgctattagaatttaaaaactaatatgatttaaaaaccgtggtagaatatgtgctcgataagggctggaatttttgtctttctttaaaataccaaaccccaacatctagaatgaagcctgggactttaagaggcttgataaatctattttgactacattgcttatatatatatatattttttaaatggttatcatagtgtaaatatcacttttttcacttaatgtgacaacttttttaatgttcccacaaacattatttttaatgaatgcgtagcttttctaccaaatggatgcgacatattttgctgagacatttccttgtagttggtgatttcaataacaatactagaactctagtaaataatacgacattgaactgtttttttccctattcagtattgtctcctggagatataatcctagagttggcaaacctgaatcaaatggtagaaatatgtaacacttcttgatacgtattaccaaattggttttgcataagttttgtaccaattgacagctccacttgccataaataatcgtctctttggtcatacgcttagcctatacaatggggcattgtacacatatatgtatacacgtgggtcatatatatgataataatcaatgatgctctattttgattcataatttgcaattctttactagtgaaggtgattttcagttgttgcattcttttatttgttttgatctagatgttttagtatttttattttctaatgtttagtagaaattgtgtgccattttatttttatatttgtttctaatatgtttgttttgttagctacttactattgatggtttattttaatatataagaaatttccatttcatataataaaaaagcaaaaacaaacatctgttaagggctgtgctacatgctattagtacttactgttactatctccaagttacggatgagggaacagaggcctagggaaattaataacatcttcaatgttacacacatgaaagagtcaaataagcatttagattatagaacagaatttgaaaactggtacatgtaaagactgaagcattttgtttggttcctggagtatttaaagcttttgaagagcctggtgctgtgactcatgcctataatctcagaacttgggagctcaggcaggaggatcacttgaggtcaggaattcaagaccagccttcgcgacatagcaagataataccccagctcccactgccctgaccccagctataaaaaaaaaaaaaagaaagaaaaatttagctggtcatggtgatatgcacctaaagtcccagatacttgggaggctgaggcagaaggatcccttgagccaggaagttctagactgcagtgagctatgattgcaccactgcactacagcctggacgaaaaagtgagccctccagcagcctaaaaaatctttcagtttaattttcagttaacagttatttctgtctacactggatctgtattttctttttctcccacaactcccacaaatagttggttttatctgagtagtgactggcctcttttgaaaagccatgcaatccagtttgccacagtttcccctccaaaattcctgttgtctttagcttaaccttttacactgaactacagaattttcccgattcttgtgggtaagggtcatactcaaaatatttaacaaccagtttggcatggatgctggtcattcaaaatgtcagaatggacaccaacaataaataaatggtacacctggatatcctgtctgtgagttttcctgcttaaactattcctttagaaagcagcattcttttttttttttttttttttgagacagtctcgctctgtcacccaggctggagtgcagtagcgagatctcggctcactgcaagctccgcctcccaggttcacgccattctcctgcctcagctgggactacaggcacccgccaccacacccggctaattttttgtatttttagtagagaaggggtttcaccgtgttggccaggatggtctcgatctcctgacctcgtgatctgcctgccttggcctcccaaagtgctgtgattacaggcgtgagccaccgcgccgggccctgaaagcagcattcttatctactaagagtttttgctaagaattttatatctattatctaatttaatttgtataaatttaaatattatcatctgtagttattctcagatcatcaaatcttttttactccagtggtttgattaaatacttgttttaagtttcctcatactttttccaccttgtttattttaggaatgaggtagctgagatacagattattaccaattcaacatcaggacttagaaacttggctactttcactccttgttgtttggatctggcaccattgctgtggttaattaccattttccacattttagcatgcagttgtctattctgtctttggtacatccaatagtgctgcaaatacgttatattacaacctttactttgtaaagttgaagatatcttctgacgctgattacaaaggaagatgttcttaagtgtacaaatgtagtcatggtggaagttctctcttagggcatcttttcctcaacataattccatttttttttttgtcctcgttgacttgatttttgttagtggttcagtagaataagttttatgaatgactgataccagtaaacaattgaagtcacctgtttgtaaaaggaaattgtggaggattcatggcagagtgcaaattgctgaatgaaaattagcctatggcccatttatcaaaactaatgtacaaatgactttatatcatcattgtaaagaaatggctagagtcattggcataaaatttgttgtacagggtcttatactttttatttgtttccaaatcaatgtgctaatttccaatcttctattaccctcccccaccccatttccctttttttctggttctttagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggtagcaaatgcttctttgtctgtgaccttactcaggagtctgcaccgtggtgggcatgaacagtgcccatgggaacactttgcgggtagattcactgtgattaagacatggatatatggcttgaagggaattgtgattttactagtgaaaactttgggtaagtacctgttaaaaacctgttttgcttctcagagggaccttctttatcctttagcacatagaatcaatagcagggaatagtaacttcctatcctaattttagattctctcctacgtgattttgttcatttgccccatctgctctccaccaagaagaagcatgagcctagaagacccatttcatatttcatttctgaagagtctacatgtactatttgtgagaaaggataaattagtcaccttatatgaagagagctgtttttaaaaaacaaacatggtgtataagtagatgttctgagtatgtccgactcttccttatagaaaagatctcataatgtacacattcaaaataatagtataataaaaagcttaagggagttataaatggagaaactggtgcaaatgtttttatagactgtagataagaatttattgaaagtatttgggagtagttgacaatttgagactaaagttgtttaaattattttagcacaaatatatccatattccagaatttttaataataacttattttattatctaataatattagatgtgtctgtttttttaaattttgtatcttcagagataaatattactttagctttatttgtaaaacatcttgcaacttcttgacaaagacagttgaaacaaggctatttaatttgaatttattgtgacagaaaagcagcaaagatttacaacaaaaattttatttttatatctaactttcaaagatgacaaacacttgctaatttgtgaatgtaataaattatgttatctcatactttattgttttgtattataggaactttattacttgcatatcaagtacaagcacattgatagagggttgatacagataactgatgttactagtatgtaattttaccacattaatatgacagtttctaaggaagtaaaaatgctatcttcttctctatattacttggtttacaagatgtttcttaatcctaaaagaactttattatcgtatattcctaaaaaggctctttgacaagtgatataaaatatatttatttcttttagtagtgaactttccaaaaagaactcttgtatattattgatgtacaaaataccttaaagtgagagtattttcttttgtcccaaatggaatcagtagctcatggctacattttgaagtatgggtagcctttctttagtttttagacttatttttgaatgaatactgaagctttatttaaatttgacctttgaaacaataatagaaacattgatatctagatctgtttctttccttccagcatgttaagatggcaaagagaaatgagtaaaatgtacatttttcaccatactttaagatgtaagggactgtgtagttcattttgctgctttaagtgagacatgtttccctaaatacagggcaatactgataagttactgctttagatacttcttttcatttatattgctgcctttgatagctataaagttaatataaattgtttagaaagaaatttattgcttaattttactcaaaaggtaatagtagcaagtagataattaattgttcatttggcacaagcaaaacaatagtgttggtttattgacatctggaaaatattggaaaagtggctcctgtgagaaaaaagaattatgagatagctaaaaggaaaatttagcttttaaaatgattttccaaaataataatttgttttcttagaaaccaaagacataattaatattactttttcagattaggaagttttttgatttttagaatttttattttgttttgtcttgtattttttatggataaagctaaaagttgatgcttttcattaagattttatttttatgagaaagatgcattacatgatgctttatttatattagctttttgaatcgttagcttctgtaataatcaacatttgttgagttagatgctgttattccatttttccacctagtgaactgaggtagagaaaaataatgatacctttccaaggctacatagccaataaattgttgctccaagatttacagtcttgccctgtctgcctccaaagctcttaagttgccctgcctctctcatgggccagaacatctagcaatagagggctaaagttttatttctttctattgttttaaacctcattcatgcaatctttgataatgaatagtagtggtaattaaattgtgtgcttttctagattcctatgaaagattaaagttcaaatacattggggctttgggtgaagcaccaaattaatttgaccaacccaagtatctatatagaatttaacagtaaggcagaatttaagcattccttctgctaccatggaatattatttcattacaatggaataataacacccattaagggagtgtattgaagccaaaacaccaaagattttaatatgaagagtaaccagaaatgcttctaactatgtccttctgggagtaataaggctattatggttgatatacagagttagcttcctgttgctccagagtgactctgatgccattccatataatagctttttatttttgttctattactttttggtgtaaaatcaagagttttaggcacctaatgtaaaaaacaaaatttactaatttcattagtattgaaagttacaaacacatgttgggtatcccttatctgaaatgcccgggaccagaaatatatcagattttggatttttttttctggattttggaatatttacatatctgtacataatgagagtcttggagatgggactcaagtcaaaaatataaaattcatttatatttcatatacaccttatacacatagcctgaaggtaattttatacaatatttccaatagttttgtgcttcaaacaaagtttgggtacattgaaccatcagaaaggaaaggtgtcattgtctcagccacccatgtggacaatctctggttgtttggcatcactgttgttgctgagtctgaatgtgaggaacatgccattggcatgtcttgcccacacacacaccattttgttatcttttgtgggtgtgcttatgtgggggaatctgggcgtgtgtgaaaaaaatatattgcagctgaaagggggctggaagggtcttttttcccatggtgaagctgactaaactttgtgctgtgtgcctgcattttgactggaactcatcacatgaggtcaggtatggaattctccacttgtggcatcatgtcagtgctcaaactatttcagatgctggagcatttaggattttggattttcagattagggatgcccaacctataataataataattaaaatcagtagggttcaaacttaaaaactaaattttatgtacgttatgaatatgcggctgaagagagatattctctctcttacatatgaggaagtatggctccgagtagtttagtaacttgtccggatttcatatctactaatgtcagaacctaaggagaactcaaggtctttagttactcctcagtgtgcacatttactatagttcatagatatatatttctcagtctgagtggaaatagacatctcaagatggctattaaaaaagaatgcttcaggctgggcaaggtggctcacacccgtaatcccggcagttagagaggccaaggttggagcatcacttgaggccaggagtttgagactagcctggggaacatggcaagactttgtctccactaaaaatgataattttaaaaaattagccaggagtggttgtatatgcctgtaatcctagcaacttaagaggctaaggtgggagtatcgcttgagcccaggagattgaggctgcagtgagctataatggtgccactgcaatccagcctgggcaacagagtgagaccctgtctcaagaataaaaataaaaataaaaaagagtgcaagaatgcatcatattcatgtcattcattgtttgagagtgaattcaagggattcagaaagctaaacaatagtgcattaaaatgaagttttgtggaagtggtttcttcttgaccagtgtctttaatctaaaagcttttatgtgctgaatgaaagaataaagcttctgctattttgatattttgagagactatatgtatataatatattctacatattatgaatatatacattgcattagtctattgagaacttgctctgtaagattttgaaatttttagcatttgtttacttcaggtaaacttcccccaaattaatttaatatctcaccattctgtatttgcgttgattatttttacaccattttttaggctaagaatggaagatttcagttgttcatttataatgtgagggactttgtaaaataggcttctgggcagtccctaccttttcctgtttgtatgttcaaagaaaagtcattaagggaactaaagatttaattaaaggaaatgggaagacctgagtgaatttaacagttagttttgatagggatgcacagataatggagctacctaaaacttgcctgttgatgacgttaagaccttcactgcattagttgcttgtccttagatttcaatgatttacagaaaaagtgggtacaaatatgaactaaatacaaacaagttccaaaagctcataacatttcagttttggtcagtgatgactatgaagcctaaagaaattgcacactctcatgtctttctcttctcgcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagtaagaggcaccagggtaaacgatggactctctttcctcatcgttagctgatcattattcagaacaaagcctgataaagagtgcggttagactcgtcaaaattatctgtgtttaattaaaagcatagattacagacccaactgtaaagttttgacatttacataccagctcacatcattgagtctgcagagcgtctcaagaagcaaacgtaacattatctggcaaaggtgctgatttctgttgttttgaaccttaaaaataatgtaattctaaagcagtctaatatatgccatcttgtttaataatcagcttgtatccacatctcctgactatgccttccttactcctggccaagtaataattgctctctaagtaaagccttgcctccatttagttttggcatactcaaactttgagaagatttaagacataacacatgcaaaagaactatccacaagagggagacagatccaaataattcccctgtattaggtcagttcaaaatcaggtcgtagcaaagtttaaaatttgatgacttgaactggaattgtcagcaatatttatttgtttaatgctcaaagggtttttttaaaaactaaggttttcaaactagcaactcagaaaagattattttaatgtgtttaagggatttaatatggatctaatccctcaagataacttgattattaaaatacagtgttttgttcctctgcagtattttttaaacttaaaaaagttgattttgggaattccctctttgcaaaagtaattaaagaaatagctgaaagtcttttgaaaatttgcaatttaagtagtatttataaagcattactgtactattttctaaagcatatttggactgtggtttcttcttttaataggaaaactttatgtgctgtgaccagcgattttacttcttaatctttgtcaaatattctagaggcatgagaggacaaaactcaccatcaacatctgtttctgtgtgtgtatgtgtgtgtgtgtgtgtgtgtgtgtgtgtgtgtatttcaggggcagtggcaagtacagaagtaaagcagaagcttcaagagttcctactgagtaaatcagcaacgaaagacactccaactaatggaaaaaatcattccgtgagccgccatcccaagctctggtacacgtatgttcagtgtttggctgttttcattcctggggtaaagaacacaggttctgtatttagccgacctgggtacacatccttagcctgccatttctcagctgtctggctgtgggcaagttccttcagttctctaaggatcagtttccttctccataaaaagaggaaaataatagtgcatgccctctagggttgctggcacggtcctataaaataacatggtaaggtacataacagagagaagtgctaaataaatggtagcatttatcaacttgagggcaaggaagtatatatgttctttgatgaatgaataactgacaaatgtgaggtgggcaaagaaatttgtattttgcatttttccattctcaactggtgcatttggtatctatatagtaatttcaaaaggtttagcagattgtgattttattacacttgacttggtgtaagatggaggtcagagctattttcaaaaatctagtagaattttgtctcaaatgaagaaaaaaggaaggaagaaaggaagataagggagggtagggaagggaagttgagaggttgctaaataaataactctaagtcttcagtgaatagtttacccctgcccacctcacttcatttcttcccagacagcaaaataatagcttggctcctgacacacaacctgacaacataatacactgtggtattgtggtttttatagaactgtatttctgtaagtccaatacacaaatatttcaataaaatatagaggatgtggtgattttaaaactcagggcaaagaactgataggcaaatcatatatggataataaactaatagataatagtttcatttctttcttagaagtgtttgccaaatgaccatatatttttacacttatatatttttcaatccctcacaccattaaagataggaatagtacttgattactctgttatattaatattgtaagcagcctgggagttctatttaaagagttaatgtacttataaggctattttataggtatccgcccttctctgcatcccaaaacaggtaacagacagataccataatgttttataaatactttttaatgattttcataatttctgtcatgtatatcagttgacatgaaaaacaaatctctgaaaaacaatttcaaatattcaatcaatatcacgaatgatttaaaaagaaacacgattttgttacctaaaactacacacataatttatagctaattcataattcaaaattaaagtctgttctaagaaaagataatagcattaaatgagaaacagctacatgcaaagaatttgtcggttaaagttcattagctgttctcttaggtaatattaagcatagctctcacatgttacttagcagtatttaccttgtttttatgaaattgaacttcagtagagtccaactgcagataaccacaaacgattaatttatagaatctgaatttaatgccatttttgccagttatagctagaagaaatatccttaaaccaataaagtcttaagaatatatgatttaaataaataatactggtagaacaatcattgtgatggtgatactatgtcctgttcattgttttcattacatatgtaattatagatatttatatctactagatagtcaatattcagtcctataaactattctccagcagcacagttgcatctcttagattgtattcacccaggaaaaagaaaacatttaaaaaaattggtttcatattaaagaatgtgatccccattctttactactgaaactgccccagaagtcaggagatgggagtccgttggcacaatcctgtcttttcagtaaaaaaggctactctcatgtactcacatgtactatctagcaattttttaaaatgaagtccttgcgtatgtttactattaccttgattgttttatactgttgactagaaaggattgagatgatgacttttcccctagggtggctcttaagagaacataggcagtaatctcaaattgtcaaaagctcagactcttggtaaattattttagtgaagcaaactttctatgtgactgtatgaccaaacacatgctggacatccttaggatccctgcatcattccatagcatactgctacagtgaacttggttatgtgaggctatggtttgtatacactaaggagaaagagcataaacatagctgaggcacgtgtacagcgtgtgcagctgattattgctgaccaatatgcagtaaaaactaccaagtaaatagtgaaacttccttgtcttttctagggctgcccaccacacatcattggatcaaagctctccaccccttagtggaacatctccatcctacaagtacacattaccaggagcacaagatgcaaaggatgatttcccccttcgaaaaactggtaagttggtttaacaggaactctgtttgctcttctgtaacacacctgtaagtttcattttgccacacctctagaagaaagtcaaaggatttgagtcgtagataatatacctccccacccctgcccccagcataagcaaacaatgcacacacataccctacttatttctgcatcagttgattcatgacataatcaaaatatctctttttcagtttaaaagtttatcatatttgaactttagccaaattattttcttactaggaataaataaaaataaaaatttcgtatctcggaaaatctaactcttctccattagatagggcctctgtaatatctttcattgtcctgtttttctgctgtacctcaaccatttaccacaaaaacgagaataataaagtttaatttttccaataaatattttacaaaccttaaattttaattgtttttgtggtgaaagcaggtaaggccaaagctaccttctgagtaagtgactagcctaatatctcatggattataatagaactcagagtgaaattatatctgataatctcatgaagttaggggaaatagcgcaattaagcttttatttagaatttagtaaacagttctgtggctctaaggattgtatttgctgttccatcttcatctcctttctgagcattctgatatgtatatatttaatgtcttatatgcttttactgctataataaatgtttaactagatatacatataaatagcatttgtgtacattctattctaaatctcaacgttgtttgccaaatatagttctttagagacagtagtaaatttaaaaatgtttatctccacaactgatctgaaaagatattcatgtaagatagcttggtctattgtatttgactcagatctacttgaagaagtatagatttatttgttttatatatgaaatctgcagagtgaaaatgatttcaaataattatattcattttcccaagcaattttgagaaattaaaatgaatatagattgtaaaaacacatgccgaagctattttttgtcatataatttacctgtggcataatgaagattttaaaataaaatcagttatgaataagaatttattattcgccatctagcatatattgaaggcactaggaaaggatgtttaactattgcaaaacaacctgtggctttttaatttaaatagcccaaatatttttgcatttctactaaaagatgataagtattataaaataccttaatagaaggctatgcaaaggcaaggataattgagttttatgtattgcatcagaattccaccctattatctgcaaatcagagtgtcttataaataaacttttctaggatgaaagaaagcaaaatgtgagcctctatgttatttctaaaacatgagtatagtttatgaaaagtgatccataaaggacaggagttttagaatgtggggactttgatctgcaggcttgacatttatttgtgagtagcatgagtaggagctatttactgagattatgcagatactaccccaggtcttagggcagtgaatggcattcaagaatctaaggagttactaaaaggaaagaaaaatatggattccccttatggcaggaggttactgatgagtgatatagttacattcacagagaaagacttctatcctgctgagcacagagcctttgaatatatccttaccactgggagattgaaaactgactgcagaactgataactgactttgaaaagaagtggcatttgggaacattaagcacccagtgagaaaatctgatatttttaatacttaaggagaagtactaaaaacccatactttgtgtcccactgttgccatgcgaacagcttaaggtttttcctctgtgaagaataaataacaagctgttaatttattctcatagatttttttcaatccacaacacaatttaaaaagaaatccttctcaggatatatatgttacaaaccctatttagatttgtacaaatatgcaagacattttctgtgccttattatgtgctatataataatagtgaaaaatccctggtcttttctagaggtattttttctgtatttgatcagtatttcatgtttcttccttttatgttgaaaatctgatatttatgaagtgtctggctgttgatctgtaaaaccaaacattttcaagcatcgtagcaataaagttcttgaacagccattaatactttagtatctctatagaggttttaaaatattccttaattcaattccaattgtctgtttaagaaaaataagatgtaattaaatacagatgctttctatactctatctaaaatacttagagatgcccttcattaattacaaaataggtggaacactcagcttttataaatataatccatttggtgtatttccaattccattatgagaaaatttagacatatatttgcactaaaagaataacactgaaatgttgtcaaataatttttacttcaatgtttattgtatttcagtgactcaaaagtatttacaaacaaagcgaacaataaaattttaccataataaaacatatgtgatgattggggaaactgtttaagatagcttgtgtaaagctacatcatactaaatgaaatctggaagagtgtcattgatcatagagtgtaaacaccagcccagctactgtagagtgacgctttgttattagagccagattctaaacctctcttgtctgcttggatttcattgaactcaatcttagagttaaaagaagttgttaaatgagtgtatcctatcgtttgatctatgtatgatactattttagtttcttttaaatctacatcagcaatatgtattagcaagcaagatttacgagagtaaaactggaatcagagttagaaaagtcctaatgatcttacattgattgagatagccctaggatgtcccttaagcagtgagcacaatttgaaacctctcttgaccttttaggaccttccccagacagtgataacccgggaacagttaactacagaaacctcatttgcctgcagaaatctgacctttgtcacgcaaagtggacctttacttccttccccttaggagaatgatagttgctcctagaatttgggcattttagaaacatggaattatattaaaagttggctctaatcatgcccattccaattcacttttctttaaaatgtaagaatggagtgacttctcctcctttcacaacaacatcaaaggctttacataacttattttgaagtggaaaataacaattgtttttaatttttatatgcattgcccacacttaaagtagtacttccttctagaattatacattgtaattaattttgttctataacacaaggataggttgataggaaaatttggaatattttactaaacttatactttggctgaaaatagtatcattgctgtagtagatgactttattgtttttatatagtacactgctgaactgataataaactatgaagtagggaaaggaagttttggaaatagtacatatttcctggcactttggaaatggtacatgtttctcacagagattctacatatgtggtgattttgaactgaccttcaaaaccatttgattggattctgttccagtgagtgtgtgcatatgtttcataaaatattgtgataaaatttctagaagttttaccctccattatattattgaggttttacccaatgaactttgcctttctttgaatattacagtctttccatttaatacttctgaacaaagtgagttagctggctagattaacctcttaaagtgcacaagccatgtaaagcttggcttgggctgataagagacttttccagccccactgaaatatttattttaatggtcagcaacactagaataagactcaaagatggaaagagtccaaacataagtgaaggttttggaaggccagtatcattttccacactgagtaaactggaacgaaggcagagattagatatgtagctttataaattgccttttggtatagcagtcagcagttatgttctagtaccttgatgacctattcaagtcattataataaaaaacacaataattatttttaatagtttagaatatctcttcctctctctctccctctttctgtgtctttcagaatacacttgtgcatgtgtgaattgcatacatgaacattatacacatttctgcaaagatatcattaaagatggcttaggcttataacgatatttgctcaaaatcttattcaagattgacgaacactggagcatttttatatagcttagtactctatcttggttacattgttttgactaaacttgtcaaagtttatttttattgaaatatacttcttttaatgaatcttatactagttttctcagaattgagaagtaatatggccattgtaattcaggctttgaatccacacataccacttggaaatttgggtcctcaatcttgagcgattaatttaacctctctaggccacgattccctcatctgtcaaatgaggataataattgcacttggtttgcacagttatttttagaattcaattaaataatgcatgtaaagcacttaggatcatacctaggatttaaggagtgcttactcttgactgtatgcttgtataaggaaatgttatttatttctattatgccaaaactaaatctctttttgttgtagaaggtctttttaatgtcttacattcttctacctttattaatagaacaaccaaactaataaaaaggtgatcaatattttctttttaagctatgggcaactcacaaggctactgtcaaaatgagggtaaagttatttgttaattttgcatattctctggtatttcagagctcactatggtatccaaaagaagcagcaggctgcatgcctatagtcctagcgactcaggaggctgaggagggaggattgcttggcccaggaatttgagtccaacctgggtaacatagggagaccctgtctcttaacaaataaaataaaaaacggagcagcaggcttgtttttgttgttcatcgtaggaggaagtctgattgatgttctgtgctcactagggccagagttttaatttctgctgttaacttcatttttaaagtagcagactttaattttaagaaaagttttatatttacagaaaaattgagcagatattgttgagttcccatattgttgcctcctcctaacccctaggtttctgctttttaaatatcttgcatcaatgtggtacatttgttgcaattaaggaacaactattgatacattattgttaatgcagtccatagtttatattaaggtttactctgtgttgtaagattctatgagatttaacaaatgtgtcatatcatgtcatatatccaccattacagcatgatatagaatagttttaccaccctaaaaatctcctgtgccccacctattcatcctccccccacccaacttttggtaaccactaatttttttattgtctctatagttttgccttctgcagaatgtcatagggctacgatatgtggccttttcaaactggcttcttgtatttggcagtatgcatttaagattcttccatgtattttggtagattgaagcttttttggttactgaataatattccattgtatggctgaaccactgtttatccatttaccttttgaaggacatttttgttgcttccaaattttggtgattatgaataagctgctataagcattcatatgcagtctttgtgtggacatgttttcagctcaattgggtaaatacctaggagtacattaactggatcatgtggtaagacttgtttgttaaaaaaagaacaacaaacaacaaaaaactgtcaaactgtcttccaaagtggctgtactattttgcatgaccactagcaatataacagagttcctgttgctccacatacttgttagcactttgtattttaagttttttttttttaattttagccattctaatacgtatgtagtggtttctcattgtggttttaatttgtaattccctaatgacaagtggtgccaagcatcttttcatatgtcatttgctatctctgtatcatctttggtggtgtctttttagatattttacattttttaaattggtttttttctcattgttgagatttaataattatttgtgtattttgggtacaaattctttttttgctgtttgtcttacaaatatttttcctcaatcagtggtttatcttttaattcttgtatcattgtctttcacagaacagaagattctaattttattaaacatcaatatttcctttcatcgatcatgcttttagttttatatccaaaaattttttgccaaacccagcgttaactagattttctcctgttttcttctagaagttttacaatatttcatttagatctataattcgttttgagaaactttcaatgaaaagataaggtccttgtctagattcattgttttccatatcggtgtccaattttgctggcaacatttgttgaagagactatcatcctttctccaaagaattgccttagctcctttgtcaaagatatatttgtgtgggtttatttctgggctctctattctacttcactgatctacttgtctgttcttttgccgataccacactgtcttgattactgtaacttcatagtaattcttaaagttgggtactgtcagtcctcttaactcttcttccatattgtgttggctatcctgagtcttttgcctctgggtataaagtttagaatctgtttgtcaataaccaccaaataacttactggaattttgttttgttttgttttgttttgagacagggtctcactctgtctcccaggctgcagtgcagtggtgcaatctcctgggctcaagtgatcttcccgcctcagcctcctgagtagcttggcagcataggcacacaccaacatgcctggctaatttttgtatttttcgtagagatggagttttgctatgttgaccaagttacttactgggactttaactgggattatgctgaatctaaaggtcaagttgagaatagccatctgaacaatactgagtttttctatccatgaatacgaataattctttcatttagattttctttgatttctttcatcaaagttttctagtttttctcatttacatcctctacataatttgtttgatttatactttcctaatttttttggtattgatgtaaatgttactgtgttttaaatttcaaattcaaatggttcattgctggcatataggaaagcagctgacttttgtatattaactttctatcttgccaattggtataacagcttattcattgccagagttgtttgttgtcattggttctttgggattttctgcatagacgatgtgatttgtggacaaaaacgttactttatttcttcattcccaatctgtatgccttttttttttctttttcatgtcttattgcactagctaggacattcagaatgatgttgagatgtcgagcaggagaagtaaaaggggacatcctcaccttgttcccaatgtcaggggaaagcattttgtttctcaccatcaagtgtgatattagctgtagattttgtgtttgtgttgtcaaattcaggagttccctctattcctaattttctgagagtcctcacaaattaatgttgggttttgtcaagtctcttttctgtatcaactgatataatcgtacgattttttaaaaagccatttgatgtgatggtttacattagccaattttcaaatagtgaaccaacctcatataccaggaaatcctacttgcttgtgttatacaacactttttgtacatcattggatttgatttgctagtattttgtggaagattttaaaatctatattcaggagagataattgatcaatggctatctattcctataatgtctgtatctgattttggcagtatggtaatgctgtcctcatagaaagagttaggaagtagtcctcctattttctggaagagattagagtattgataccatttacactttaagtatttggtaaaatttactagtgaaaccatttggacctggtgctttcctttttggaaggttattaattattgattcattttctttcattagatataggcctatttaaattatgtttttctccacttgtgagttttagtaatttgtgtttttcaaataattcatgtgacttttcaaacttgtcagtatagagttattcataatattgctttattatccttctaacatccacagcatcaatagttatgacccctctttcatttctaatattagttattagtttcttctctcttactttttttttcctgacagcctgactgtagtttcatcagttgatctttcaaaggaccagttttttgttttgttgagttttctctcttgatttcctggttataattgtcttgaatttcccattaatttttactttttttttctgcctactttaagcttagattgttatttttcctctattttttttaaagtggaagctcagattattcaatttttatcttttcttctaatatatacacaatgctataaatttgcctctaggcactgcttttacagcatcccacagattttgataagttgtattttcattttcatttagttgaaaatattttgaaatttatcctgagagtttttttaagtcatgttttatttagagtcatgttatttaatttctaattacttgagtatttgctagctgtctttctgttatttattttaatctttctgttattgatttctattgtgggctgagaaaatactgtgtacacattctgttcctttagatttgttgaggtacatcttatgcctcagaatgtattctgttttggtcagtagtactaaagtctccaaccgtaataggtttgtctatttgtccttccagttctaacaggttttgcctcatgtattttgatgtgacattattaggagcatacatattaaggattgttatatcttcttggagaactgtgactattttatcaatatgtaacaaacaccacttttatcttcgataatcttcttggctttgaaatctgctctgtctgaaattaatatagctcttccaacatccttctgtttagtgtgaacatgttatatctttctccattgctttacttttgatctgtgtcttatatttaaagtgggtttcttttaggtaatatgtagttagaacgtcttgttttttaaatttactgacagcctctcttcgtgtattgagacaattcacatttaaaatgatcattaatataattagattaatatctagaatgtttgtaactgttttcttcattatatttacttttttaaaaaaatattcacttctctctgactcctctgctattcagaactttatataattcagtgctctctactctcttaacatatcaattttacctcttttaaaaatatgtttcagtggtttctctagagtttgatgaatccatttatagtgaatccatgtccactttcaaataacagtataccactttacaggtcatacaggtaccttataaaagtgtatttctaatctctcccttttattctttatattgctgtcatttatttctgttttccaaaagctacaattatccagtattttgttcctattattattgtgcacagttaactattagatcaattgataataaaaataaaagattttcttttaccttcatatgctccttcctttatataggtctgagtttctgacctatatccttttccttctcactgaaaaacttttaacatttcttgtatggcaggcctacaggcaataaatgtccttagtttttgtttgtccaagaaagtgctttatttctccttcttgtttgggataatttgtgttctttttaaaatttttttggcaacattttgtactatactttcttttttattctacagcttatgacaggacatctgatctaaatcttatccttgttgctctatagataaagtttttctttttttctatggtttctttgaagatctctttatcttttatcttctgcaatttgaacatgatatgtctcgatactgagtttttggtatttatattgtttcatattctctgagattcctgtatctatggattggtgtctgtcattaattttggataattcccagccattattatgtcaaatatttattctttctctctttcttgttattttgctattcccattaggaatatgttataccttttgcaattttcttagagtattggggaattctgttccatttaaaaaaattgttttttgcctttctttttagggagtttctattgacatatcttcaaagttattgattccttccttagctgtgtccagtctactgatgagcacatttggaccttttttttttttcttgagacggagtcttgctctgtcgcccaggctggagtgcagtggcgtgatcttggctcactgcaagctctgcctcctgggttcacgccattctcctgcctcagcctcccgagaagctgggaccaccaccacgcccagctaatttttttttttaatttttagtagagacgggtttcaccatgttagccaggatggtcttgatctcctgacctcatgatccgcctgtctcggcttcccaaagtgctgggattacaggcgtgagccaccgcgcccggataagaccttttttaaatttctactgctgtgcttttgatctccagcattcccttttcaatctttcctagagtttccatttctctgtttatattatccatctgttgttgcatgttgccaacttcccattagaacccttaacatactacttttagttcctttaagttccctttctgttaattccaaaatttgtgtcataactgagtctggtctgatgtttgctttgtctcttctgattgtttttcttgccttttaggatgctttataattttttgttaaaagcttgacatgatatattggacaatagaaattgagtaattatacttttgatgtgaggttttatgttaatctggctggggctgggctttgtttaatatctgttgtagtggtaaatgtcagagtcttcagttttctctagtttcctttgatttttttccttctcctattgctttggggtttccctaagagctccttcttaaatagaatttgtgtcctgtagctccctcagttttaattcactgttataatacagaacctggttgatgtgatggtaaggcgttggacaggagaaatgttctataaccttacaactaaatttcatttttttaagtgggcctgactttgtatgctgtgatcccttgaactacttcttagcctgtttcctccccttaagtaagataggaagctgagatttactaattgccttctcccttaggtcagataaggctctgtaaaatattttcccttggagagtaggctgttgttatgaagaatccttcgtgtgtatttcaaaattgttactttttcattagacaagtattacaaaatggttacttttcttccctctcccacgcctactccctaccttcacttaaacagaaagggatttttttctcatatattcactgagagaaactggttgggttcctggaagtaaaacccatgaaaatgtaggattcttctgagactgggcccctggagttttgtttgtttgtttgttttttgagacagagtcttgttctgtcgcccaggctggaatgcagtggcatgatctcggctcactgcaagctccgcctcccaggttcacgctattctcctgcctcagcctcccgagtagctgggactacaggcgccctccaccatgcccagctaattttttgtattttcagtagagatgggatttcatcgtgttagccaggatggtctccatctcctgaccttgtgatctgcccacctcggcctccgaaagtgctgggattacaggtgtgagccaccatgcctggctgcccctggagtttttaactctcaagctggttcacattcagcctccagcaattcatgcctccaacacctcattaaaattacctcatttaaatatttcttcgttactgactccattggcttctgctcactgtaagctgaactcagctgtgattttctgtattttcctatttctccagattttagcatggcagtttgccctgcaaccttaattctctgatagatctacgaaaataattttaatttttactttgttcagctttttacttgtggtgaggttgggagtgaaaatttcccagttcttcacatgtggaaatgaaaccagaagactaccacttacttttaaatctgtaaaacattaaaaatactttttaaaactcaactttttcattttttgaggtgacaaattcatatttgagcaatattattcttacaaattaatgattatatttattttaaagattaacatcagtgtccagcttgctcatgattaacaagttcatatgctaaaaactgagagagagaaaataggttgaaattattttaagtcacattttgtaagcaagacttgggaattgtaaggactttttgtcgatttttgtcttactgttttcataacattaaaccatttagcaaggtatgaaaatcaaaccaatttttgacctgtatcaaattagaaaattttagcttcttttcaaaataagactcacttttaaagtaatatttttttctagataataatttactttttaagcattcattttgatagatgtaatcatttagattatgaaaagttggcaatttcaaaagaacatatttagttgattttaagatactcattttttaaactaacatatctgaaatctgaattgctctcatggatgtttatagtttagtagtgctttctggtggcagggagttagtggtatacaaggtacttgtaaatgttgtaattgattaattaccatagtatttacccaacaattaaatggtccagaatactaagattcctcatgataaagaaataatacaaatgtataatttatacattttttactttaaaataacaaacatagtagaaattaataatcctaaaaattttttatgaaaaagttaagtatgttagtttcaaatcaatgaacaaaatgatttaaatttcacagttcagtaagtgagaagctggtttcattgattgcatatgcaatttgtatgacaagtagttggagctaagagcaagtatcaaatgacaattgtgtgataatgagtcagccttgtaagaacttcgaaaatctaactcaaatattttgcttgcagaaaagctaaggtagcctagaaagacaaagcatggaaaataatttcatggcttggcattagatgaacaaagctgagaattctagcttggcacttttgatgagagctgtgtgacctgcacatagtgcaggatttctctgagcctcagtttcttcaaatagcaaatatggaaaatatttgccttccagtgttattgtaagcaaaaatatactgcccagtacagtgtgtgacatgggtctcagtacatattgccagtatgaattattaagaataatagtatggcattagtgacaggaaatattagtagtagccatataatgtaattattgaagaactagaatggcaaaaggagacttaagttttaatcttaaccttgtcactaatacatgactatgagcatagtgcttcatgattttagatttctgttttttcagttaagtgcaaatggaccaaatgattcctaagattgtatatgaaactaagaaggaaatatataattgcatttcataaagaggtgtgataaaaatatattaatgatttgaagaatatataagaaataaatgaccatgcttttgcacagtggtatctcaaattaatcataactggtaagtgcagaaaagtctaatgacatatttttcactcctcatgaaatgctcatttagaacaggcaggacattttagataagattggaatgagaaaatggcaaaaaataataattaagactttaaaagcatttagccatctgttgtataatcatgagatttattgaaaaatgattcctaatttatagtattcacaactatagaactgagaacactgaggaaatattccatgcaaatgcatgcatttatatgtctttagacttacctaatgaagtaaattaagagatagaaaataaatgatgaaatatttgggattgtattttccttaaattttcagcctctaactcagttactttaaaatggaagtgttctttatggcaaagaaattggagagaggagtgggaggggagggggactggcttaagaaccatgttattattaaaagcagcacataataacagtttgacgtgacatgtaagattttttatcaagtgactttattttgctttatgtgtatcagcctcctgttttatagatttatttgctttttagcctcttatttgcatttttatttcaatattcacagtgattcctccattatttcccacttattcatatacaagataaattctaaagttatttttcatagaaccttcattctaacacttcccttatctgtattctcatatcattgtaatttttgctataaaagctggtaattttgtcaattatgagatattaaattttataatgttgtttttatcctgttcatcccaattagatgataaaaatatctgagaatataatgcttgtaacatcttcctcctttatttgacaaaccacactttgtgctgggcctggacataaatattaaataaaccagtataagtaaaaaaggatttctgacattaaggagctcacagtcttcatagtgaggcacatgtaataggttcctaatagattgattgatactttaattcagcagttgaacagttgaaccaccgtacttcttgaggaactactatttcatattttcagattataggcattcttgagtgaaagcaaagatccaagccacccgaggaatatagctgggaaaagacattaagatgttattattattatttttttggttgtaagccttcaatatctttatttcaaaatgcatattttaatgtcattatatatattttgaagtaggtaatacagaggtaattaagagaaattcttggagagaatgcattagcctattgtagctgtacatatgtggttctttgaaaatagtatggaccagcactgccaaatataatttgatggaagagttctatattggcatggttcaattcagtaggcactagctgcatgttgccacttgaaattgaacacttgaaatgtggctagtatgacttaggagctaaatttttgttaactaatgtattagttagctcataactaattttgttaactaattcatttgaatctaagtttaaaaagccacctgtgtctagtgattatcatgtaggacagcacaagtatacaccaaggcaggcacatgtgtggcataagcatcatggtgaaaccgtttcggtgtccaagacagagttcactaatcagtcacagcaaactcttccctctgagtttgaacacaagtcttagtaaaagcattctaagtcacatcacctaaagaagatacagtgtctaaacagaattatattttcagaactcgttaattttttaaatatatatatatttttattttactttaagttgtagggtacatgtgcacaacgtgcaggtttgttacatatgtatacatgtgccatgttggtgtgctgcacccattaacttgtcatttacattaagtatttctcctaatgctatccctcccccctcccccaactccgtgacaggccccggtgtgtgatgttccgtttcctgtgtccaagtgttctcattgttcagttcccacctatgagtgagaacatgcggtgtttgggtttttgtccttgcgagtttgctgagaatgatggtttccagcttcatccatgtccctacaaaggacatgaactcatcattttttatggctgctggaagacagtgtggcgattcctcaaggatctagaactagaaataccatttgacccagccatcccattactggatatgtacccaaagggtaataaatcatgctgctataaagacacacgcacacatatgtttattgcggcactattcacaatagcaaagacttggaaccaaccccaatgtccatcagtgatagactggattaagaactcgttaatttttaagaagcaagcaccaaatacaaattagtttagtttaaaaagtgggaggtgtttggagggggtcatttaaatgaattttcctagtgtccagctgcttagatgatgttatcaattcagtgtatttaaactttgttattggaagtatgagttccagtcttgcctcttctgggttttatgtgcagtaatgctctccctccaaattttgacaataacccagagcaagcctaggctcaccttttcacagtttaacaacgatagcaaaaacaaacactctttccccggtcattctgataaattcccaggaccatctcattcggacagcttatctcacttgcgccctctagacgtttagatggagtttgcagtttacctctcaaataacctggactaagagcaaaaccctaaccagcattcatccatctaatgggcagctttgatgtataaacttttctgtttagagttttgtgtggattttcactaatgcgcttggcctttcctaagtggacttttcaagtataaattgtctaccctttcttcacaagccatcgtaagcacttcaactcaaaggaaacttttcccaatcctctatgttttctgccccaaaacagtgatgttgaaatcttacaattccgttcctttaatttgcctttgctgctgtgctattcccatgtacacattgcacctccataataatcaagtttattcagaagcaggatttgtgttttattttgggggcctcaacagtgcaaatgatatattctttcctattacattctttcctgtttatttaaaaaccgctgctaacaacacaatagagtcatgtgaaatccttcgttttttgaaacattataataggtgatcatgtaagatttatgagatgaaagctgtattttccagagaaatgcattgagacctttgtaatataaatcatatttggagaataaagaatgtaatagcaagaagagcataatgatttattacatgacagtgatgtttaacctactttagacaccacactgtgtttttccatagtaaaacactgataagggaacagcacattactttagggtattatttggtcaggaataaatgggtaatcagtggattctgagatcacaactagcaagaataatatatatttgttcaataataattttgaagaaaattaatgttaacagacttatatagtagaatagataactttggtgactatgtgctagatccattttaggcatcttacctatatcttattaactctatgcaataatcctagaaatagattttattatttctcaccagttttatagatgagagaaccgtcacagagaggtttactaactttcctaaggtctgattttctttattatggcagtatgtacaatgccaggtttgaagacagcgagttttgtttcagaatctggtctcttaacccttaacacttattctttgaacacgaataagtgatatctaatatcattgagaatggcaattttgctaaaattaagtaccatgtagcatctatcctgataaaagtagtgacttataacagtttaggtggtgtcatttgtaagttaacttcagtccaatgatgaataaagttcaaaatctttttagaaatagcatatgtttgggatattctttgtaaaagcaatgatgagagatattttcaatggaaaacaaattattaaaatcacaaatttttgttttctttctgcatcgaaatatttaacaagtttttcaaataaggtatttcaaaggtgaaacctgtttcaagttgggctttccaaatatgtttgccataaacaaactttcagaactaatttgctgattattgacagaattctgagaaattgtaaatgtcatagtagtgccaaaatatgttaatttgctaatcctataaaggaaaatacaatttttcaaatctcctgtatttcttaagggaaatagataaacttacaggcccataaataatagacatactttaattacatgggtttaaatattccatatagaggctattacaaaagggatcttttgtttgtagtacagttataagaaaacaatgaatatatctccagcttttataaaatgttttttaaagacacatcaattgtgtttgccactaccactacatatacatatgtagaaaatcatttctctttggatttattactaggataatatttatctttttttaagaattaatatacttacttattgttattacagtgatgttatgagtcctctagaagtgaaagatgactgtcagatagagaaggggtggggaaggacagataatatgcatattaatgttagagaattagagaactgaggagtctcactgaagactccagggttggaaaagaagatgagtagacacagaattcaatgatgaagaactctgtgatacggaaggcaggaagaggaataaaatgttggctatttcataggtaagcattggaaacattttaatcctttccattgtttaaaataagtaaatcagataatccagatatagtgttgagtaaatcctagagatgagtgacatgagaccacaggaaaatatttagtcagaaagagaatggagaagctgccacatgaagaaagaccatgactgttaaggtctcatctctcttttaaggggcagatactaagaggagaatatgaaagacaaaaatcaggaagtttatgtttacagaaagtttctgagttttaaaaataggtatgttaaaatttgaaactttaggctgactagcaggaaatattttaaaattttgttggaagaaattttattaaagtttatagtctaagaagttgtacatgtttataattagatatatttatatatctaattatgtatttataatagactgaataatagatatatttatatttctcttttatatataaatatatataagtataatataatagatatatttataatagactgaatacagtcagtctattacttcatagaataaagattagaaggaactgaatatattggaaagaacagtccattagttttgtcatttttttaagagtttcattagcaatcttctaattcaagctgttccaaagaaataggtcgttttcacagttgtcccttttaattttgggaaatgagacaggagagaaggaaaaggaggcgagcaaatttttactcacacttaacactgggctggaagttgtggtcactctgagcacatagagcggattaagggacatttttgctttcaaggagctcagagtctggttctaagagatttttctcaactacccctaatgtaagcgtcttctagattttataatgcttacactcaaaatctatccctctcctaaacaatgaaatagaaaaaaacaaaaattcattgaaatttactactatgtgttgtggctataatttttttctttctccttttcttgtcaaactgtgatatcattacctatatgattgagtttagaataacttttattgagcatttattctaaagtagttattatgctaggttatgatgttataaaaatgtgtatcatctgattcagcgtttggtctcttctaaatcagtgttctgaaacaataccagggactcccaaatcctgaaatctgtgcatttttctcaggcttcctttttctctgtggcttttgaccccattgtccaacccatgctccttaaaattttaacctcatgggctgccctttcattcatctgctttacctctctatttttaccaccgcgtcctttaaatatgaagctcatgaaacctgaggttcctgaggttcctaaagttgcattgtctcttctatttttttaacttttctatttcaattgtcaccatcttaaagactttgatcctacttcttattcattctaaccagtagtcgtttctgatagtagggtttaacccagctttctcatctataaaatgaataggttgatcaggactgccttcattttttttcctctaagttcttttatttgggatctaactccacatctctaaacttcaaccttttcatagacttcaggctaacatttccaaggtatcttgcaactatttaagtgtaacagatttggaagttgaccctccaatccgccacaccgcaagacttcctcctcctcctgagtttctcagttctgccaatgcctctctcccaaacatgcaagcttgacttttgggttcagttctgtctctgttgtcttctttgttgtgttcttttgtccactctgtcaccaagttctgtcttttcccccacctactttttctcatttttaaagtaggaagcatcttttcagatgtatttttttttcttccataatgcctagtgtaaacgttgcacagagtaagtgcttggtaaatatttgttgaatggagtctctcttcttctcttcttgtctgatgcttagtacttgttaagaaatggtgaatcccaattaaagtcaacaaaatgtgaatcagagcaacattctcttttttcgacccatcttaagtacaacattttttctacccatcataagtacaacatttaaaccatctgaaatagaataaactggttagaaaaatagtgttcttctttgagcccctccagaatctgaattcagtgaaaatctgttcaaaccataattctaattaagggttttagctgccaaataatatgttctggttaaagccaagttagtattatggagtgtttcatgaataacagcacaagctttaaacttgctgttgattttctcatgggaaactcaagtaaaggagaatgatacctccctgttgactttaacttttagaaatgcaaagcatgctgaaattgtacataattctcttctaaagaaaaggaaatagcatttcaatggttttcctcagtgtcttattgagttatggtggggcacaattgtgtctgttaaactgatttaccagatggaaggttacattttatatttagctgattaagttgtaagagactggaattgtatctcatactataaaggtcatatataaaattaaaaaatattttgattaactattttgaagcaattaaaaggtttaaactgttccccctcctcttttacttacattaaactaaaaatgaagttattcttagaaataggcctatcacagagttggtatttggcttaataatatctcaaatggaatgtgtaaaacaacagcaacaaaaaaagggaaatactcccattcaagttttggaaattgcttttcttggctatttaatgtattcttagtattttatggttaaattaaataatccttaatttatatacttataccctatggaacttttacagaaatatttaaaggaaataaattatactttttgtcttttttctcttttggatcttctgcaagtaaacaaatacattaataaaacctttaccgtagaaaattaaatgtggcaaagtgctaagtaaatttttgtcctggcatttttgctgtgtgatcatatatcattaatactactctttaattcctactacattacctaaaaataatgcattaaaaatacagcccagtaaaatctgatctagtcagaaccagtatttcagaatattcagacttccaaaatagcaccaatcttggaattcattcaactactgtattattttcctgtggatgctgtaacaaattactgcaaacttagttgcctaaaccaatctatatttattactttacactgctggaggtcatatgtccaaaatggctttgcctgggctaaaatgaaggcatcaccctggcgtgttcttttctggggactctgggaatgaatccctctccttgtttattctggcttccggaggctgcctgcaagctctagctgtgggctgtcccatcctcgtggccactaggaccaaccaagcctttctcaaatggcattgcactgacacttctctgcctccctcttccttattttttaaggaccccttggataatccaagttaatcttttttaagtcagttgattggcaaccttaaatccatttgtaagtttacctttaccacctaatgtgatacagtcacaaattctggggaatagaacatggacatctttggagtggggcattattctgcctaccccaagtgcttagagttttcgttaagatggtgttttctgcagtgtactttgacttactacccctttactattttatgtgaaatttgtttgcgatgcctttatccgggcagtcatccagagaaagttgactaaatagaaggtgtttaactgatgatctgtctagaaaaggattcaggggaggcctgaatgaatctagaggtgaaattttgccttttatatccattcaagataggtaatagtgtttccttataaatatatattataaagagaatgtatgatatagttcagtaaagttataaatgctattgaggtagaattgaattaccaataacgttccaaaaccataaaggttgtctaaaggttataaaatcaaaacttgcaaagcaaaataaataataacagatgcccaggtgacttggaaggttctgaaacaggacaagagcaggaagcaaagtggtatttgaactggggagaggacagtctcctgttggccagaagtcactgctgaccccttgtcagtggtgctgctgatccatggtacctgaatgtatctgaggggctgtgaagagttgaatagacttagaggttacacctaaagacttaaaattatattgtgagagataacaattattagtaacagtaattagacgtttaaaaaatgtacgtgcatctctttattaagctgaacaatgtgattccctaaagaaataaatggaaccatgttctgtccagaaatctcagaaccacaccaggtgcctagttttcctttatttcatccagtactaacttctgttattgcttgctgttaaatctcccctttcttatcgtgcctactgttttagttcattccctattttgttcagcctccattccagttattaaccactgattccatcatactcctgtccagtcaatcctttgactttctaaagtttaagtctagtcttcctaccctctaaaagagccatttactgcctcttctgttatgtacaaggctaaagctcctccatcgcaagcatgatctctgtctccttattccctctctgacctctctcaactctccccagtccactacctcatacccctttgccctagcagtaatgaaaaaattgaaattccatgaacaaatctttctgtttcccattcacacaagccattctcatctggttttccagatgctccttgctcttaaagtgccctcttcaatagttcatactcatctttaaatgctcagatgatatatatacttcctctctgttaagctttacctggtaccttcctacccaccaggccaccccagatagtcacttcatattttatgccaaatgtatatgcccaaatatgccctgacatatctctgtgcatatatctctatattaaaattacattctactcagttgaggaatccttgaggacagtatctttagcctatttattattgtatccccagcatcttcagagagctcataattggcactgaataaatttctgttatatgagtaaatgaatatatgcactaaaataggaactaatacacatttatttgggtatttaaaattctagaagttgttttgctaaataatttttaagaatttaatttgcaataacattttggaggtaggagactaactgcttccggatgactgtaactgggtaaatcagaagaaaacaaggaaacaaaatttttcatgttagcaagttgatgttatagtcttttaaatattattttattttaattcttgtggaatgaaatgacttgctagaggatgattttgcaatttaatgggaattggctaaaaattttcagataaacatcagagagacaaaaacctaaagtaatatatttgaagaagataattgtatggcatttcaaattagacagtgatttactatacttattgtagtcaatgtattccatttattacttctgaactctttaaggtcaggaatggctgttattgtccacatttgcaggcaagaaaattgaagcacagcgacattaaatattttactcagatgttatggtggtagagtcaagactggaaaacaactccagactcttaggagggtaacaagatgaggttcatgctgagagaaccaataagtacaataaagtttaggtttatgatgatacccaggatattatcaggggataggtattgcctttctggaccatgaaatcctgacctataacgttttctgggagtaattccatgctgtctccatgtgtgtccctatcaagcactgggatgcaccctaaatagatctcacctactaaaatggccccactctctcacgcagtcagttcacatgtagctcttatgaactgtctgagtaggagggacattaaaacattatatatccacaataaaattacttttcatgccatttctatttgaatggtatataaaagatatatctagtacagaattttgtatatatatatatatatatatatatatatatatatgtaggaattcgtttgttacagaaagattcatagcagaataattacacagaattttagagtgaacaggacttgtttacaagaaaaaatacataaacacatgtatgaattcagatttcccccaaagtagcatgttatttgtgaaataccaattcagaagtatactttataataaaactttgggattcaggtagaaaagaaaattattttagaaactggattgaagactgaaacatgtttataatctagttcgatttattgaaatgataattcaaaatgatgctagatagatttttaaatttgtcttaggtaaataaaatatatttgaaaaattaaagcatataaaggagttagcatatgaaggcattctggcctgtatgagatatggatttccttgactccaaaatgtagtatttgtgatgcttgccagaaaagagaaattccttctgcattccacatctgatctatgagacctcttgccatgacattcagcatcaagaaattcttagaaattagggtagttgaggttcatctagttctcttctcaacaatatttgagactcagccttttaatgtaagtttccttcatgcttggatgtatacaggcatgtattattcattcagcaactgtttatggagacccatcgagcctatgttcttgctaagtactggaaatagacacaagatcaatgattacattatatttctgctaagcatcaagggctggagccatattgcagtgttttgaggttaggaagtggtagtggcaagtataggctatttctttaacttgactatgaaagtgcaatcacaggaagtagctcataagatctgtgtctatgggggcttatttttatttgaatgggaaatatttgagcctgtctacattctgagaaggagccagaagagagagggaatttgaagatacatgttgcataacctctataagtatctcatagattaactaaaatgtgtttgatatttatctttgaagttttattttttatttagtattccttccctcaccagcatacttaatctccattctttgaatgtgtgggctctgtgcccttggacgtggttatttcctctgcatagaactgcacttctcccacctttacctgtcaacatctcactaagccctggaggatcctctttcaaagcaaatgaatgtctgcctttcagccacaacactctgcttatacctatcacgtggcactgatcccagttagtatattattcattcttgagaccatgagcacctaggagaaaaagactctctgtcttttctctgggggagttgcctcagcacttaacatgcactttttcccattccttgattccttgtttgaataaatagctaaaggatttattccatgtagttggcactgtataggtacctgaacaatgaaaatatggctacacatgcttccagtctgcatgaaacttgcaaccttgtttctcaatattattattcaatagctgttaatcgaatgtaattaaacaatagatctaattaaatagtaggttttaattttaactataaaataattagaattttataacttactattaaaatttatttttaaactgaatcacactgattaaagtatttttatgttaaaaatgataatttgttaaaatgtcataaaaattttaggaagttattttttcctgtttgtcctagtattaaaaaaacagtaatgagtagtactaaaagtagtactaaaaaccagtgttactactgagtggtactttttttttttttttaatactagaacaaacaggaaaaaatagcaaatttgtacattcattcattcactccgtaaacttttactgagtttcacctgagccagccgagtgccaggcactcttgaggcacattggtgaggaggaggaaaagtgctgctcttagagggaactgagtgcactgtcatgagctttagatgctaaggaaaaatgcccacctttccccttctagaccatgctcctgttacttacggccccgatattgtcttcccatcctactctgcgatgcttccaatgacttggtagttctctttcccatgtatgaccattttttttcccgatatgtaaagaggttatcattgttgtttccatctgtgataaacgttaagaattaaatttctatttacattgatagaaggaaatacaacttcctagaaaactcacacaatgatgtacataacagtgctgtctttcgaagcaaaacaatgtgtagtacacccaagtgtccaacattgtcttattcttaagtgaaatattgtgtattcacatgtaagtgtggatatataatatatagtatatcctcataatgtatttttaaaagaatatataattgcttggggaaaaacataatagatttttaagtgaaaaacataataaatgcaataattttaaggaatacgtaattacctgggaaaagacccataatatattattaaatgaacaaataagatataatcataaatataatgattctcattttcaaataattttacctacataacacaaagggaacattttagagtatacacaaattttcccattcttaaaaatctcaaatatgtatgacttacataatcggaagcaagcaataaaatttattataaaattagcacttttcaaaagatcatattgtaaattgattaacatttacaaatatggattttgaaaaatggtaatcttaacaagtagacaaaattggtatatttgcaataagagaatggatagatgcagtagtatttctcaaaaacaaatagtattataatgtctttaggaaattgcattcatgtattaccatacatgtgcctagaaattcccccaaaattattttttgaaaactttatatatgaattacatactgttaagtggttataattagaaatagttacattagaaattttgctccttagtgtcaaaatatataaaatctaattcataacattaaaggttcattttatcccagccagaagaggcatacattgtattatttattgtagtatgccaagtagtacttttgaaaatatgtaccttttgtataattatgaaacttttaattagagtaacctgtgtattttgattaactagactggaggatctactgtgttcccaaagtgtctttcataactgtagtgattactgatttgaacagtttctagatttctacaatgccagcctgggttataggagagatttgggcaggaactgtgccaggaaatctaaccttcagaaagaacagagagtgaatgaataggtgatagattataataagtatttggttccaagtaacaaaacatttaaatatggcagctcctaagggatccctgagaggaggagatagcaggagaaacccaggggagggagaaactgtgtggagaagttgacagatatccagtactgcagggaagaatagacaatgccagaaagggatctgaagctggtggtgaagacttgaccttcacctatgattacagagctaaatgttcactacaggtggaatcattgtatatcccaaatattcattattttaaaaacatgtatgtatgtatttatttatttagagagggagtctcgccctgtcacccaggctggagtgcaatggcatgatctcgactcactgcaacatctgcctcccaggttcaagcaattctgctgcctcagctcccaagtagctgggattacagggacgtgccaccacacccggctaattttttgtatttttaatagagatgggttttcaccatgttggacaggctggtctcaaattcctgacttcatgatctgcccgccttggcctcccagagtgctgggattacgggtgtgagccaccgtgcccggcctaaagaaacatttattaatctagtactcaatcttggttaataattaatcatcttaatatatgaaatatgttaaaatatttatataatattaacacaatggaaaattttccattttttccttatgataattttcaataagaatgaagaacttctacataccacacaatgtggtattgaaattttttaatctaaattattgttgtaaagaatattcacaacctaggattaagagtgaacagaggccgggtacagtggctcacatctgtaatcccagcactttgggaggccaaggcaagcagaacgcttgagcccaggaatttgagaccagcttggacaatgtggcaaaaccccatctgtataaaaaatacaaaaattagctgggtttggtggcatgtgcctatggtcccagctacccaggaggctgaggtaggaggatctcttgagcccaggaagttgaggctgtagtgagctgagatcatcccactgcactccagcctgggtgacagagtgagacccggtctctggaaaaaaaaaaaaaaaagtgagcagaggcaaaatacacatagtaggtggtccttcttaagtggatgatgatctagttaagacttagaactaaacagaatacaatttataagcaggcaaattagaaagtgagaaaaatatgtgaagtcagttattaaccaaaagttattttaagtacactgagtcaaagttcagaaaagggctattgttatggttatggtgttttcaaacattacactaggcaaaggagtgtaccaattgcagccatctctctctctacttattttttattttgtttaattttaacataacttcatcttacatctgcacttcatgaaacattcattcaacatctatgtaatgaacaattttttttttatgatagacaaccaggtgagccaagaaccaggatgtgtggtaggcattgttaccattcttttgtagatgataaaatgattcacagagatgaaatcactcatttggggttacagttagtacatcaaagagttagcattggtggctgggtgcagtggctcacgcttgtaatcccaacactttggcaggccaaggcgggcggattacaaggtcaggagctccagaccacccttgccaacatggtgaaaccctgtctccactaaaaatacaaaaattagccaggtgtggtggcacgcccctataatcccagctacttgggaggctgaggcagaattgcttgaacccaggagggggaggttacagtgagccaagatcacggcactgcattccagcatgggcgacagagcaagactccattgcagggggggtaaaaaaagcattgggatgagaggtctggtctatttgtgtcagagtcctgtgtgcttctacacaagatagtttgtgtgcctgtctgcatgcatgtgtatacaaaaatcacgccccgcaattatgtacacagtcacacatatcaatctcttagtaaaatgacaagtctgggcagtgtcactcactgtaccttggaatcctaattttttaacctttgcttccgccacctaggtttactattcctctcccatgttttattctcatacctgccaccctaagtttattgtgtaccatggagactagtatgagaatgaagatttgaaatacctttagttcatgaggcattcttcagatattttctgtttccttttattgaggatattttcttttaggtgagaagagaaaaaggtattgggtctgttctgttttactattgattgttttcacttaaataatgatagccaatttttatacaaagttttcatctcagcaggcaaatgtattcagatgagcacacacactaaaaagcttgccttctgtttctatgattaattgagatgtagagaatgatgggtgtggggtaaaaatggaaaggtaattagtgtaactaggcatgaaatacattcatatacaagcagaacctctccccagctagtgatctttttctgggctctgaggatttgcatcccattagtaagtcactggcatggaaatcttcagcctttggggagaccagagcattaaaaatagaattaactctaactgcaaacggagtcagcacactaggccattaattcttctgcttgggtatatatcatgctgagcttctgtgtgtgggcttctgaaatgttaggagtgagttttatagagcattgccaggactaaatgatagttatctatcatctcatctctcaccctcactactgagattttaatatctctcatgacccaaaacctgaaatacaggcagaaggttttgctagaaacattaagtaggggcctttctttagagaagttgtatactgtatattttgttaacataaatctatgttgtgctttacagtatgtcagagattccttattttcaaaaccttatgtcctcagatcatcacaatgcctcaaatgttatcctttctaaaactgagaattatgcctttttgcataactccaccaactaatgataaaagttgcctagtgttattatttttagaaatattagtggtattggaaacattttaaaatcaacttccaagtataaaatttattgaaacatttaatatatacaagctacatagagtactctcaatttctaataatctctcttttcttttcttcccttacccttctccagcttctttgggaatctctgacagatattattttctttagtcatcccagagcagtacaattattaacagctgccattgactgattgcctgtcccagggtttctcatacttcgcactattaacatttgggtaaagataatactttgtcatgggatgctgtcctgtgctttgtaggatgtttggcagtacccctggcctgtacccataccagatgcctgtagcagctctccatactgatgaccaaaaatgtgtccagatattgccaaatgtcccctggaagagaaatcttccctggttgtgaaccactggcctattctctactagtcactatttcatttgatcctatagtagctgcaagatatgtgggactggctgggtgcagtggctcacacctgtaatcccagcactttgggaggccgaggcgagtggatcacctgaggtcaggagttcgagaccatcctggccaacatggtgaaaccctgtctttactaagaatacaaaattagccaggcatggtggcacatgcctgtagtctcagctacctgggaggctgaggcaggagaatctctggaacccaggaggcggaggttgcagcagtgagccaagatcgtaccactacactccagcctgggcaacagagcgagactccatctcaaaaaaaaaaaaaaaaaaaaaaaaaaaagatatgtaggactatattaatcaggatcctggcagggaacagatctttgcagcgtgggtcatagacttttatgaagggactacttaacaaggaagttagtaaggttaaatgaactgcttagggaagtgggggtacccagaaaatagcaatagtgggaggtcattcccacaaagaagagaggggaggaaatttttcctggagtgctggagagctggagccctggaatagtggcttccagagggagatgaagtcaggaagagacatagccatggccagttatgcagcactgtgacagggagagtgtaggacagcctggcctctccctcctccttaattctttggccaccagcctgtcctgccagtagattaagcccaagtgaaatccaaccagcaaagaactagagtgttgcagctccaggattcagcccccatgggcttagagaaggaaggacaattgaatctgttggggggaaaatgaagaaaatccctccaacatccccattttaacatgagaaatcgaggtttaatgatataaagtaattcatccaggcatctatttgactccaggcacaatgaaggtatcatcttagttggtctgtgtgaatgaactgatgttcagcaagactgtgaattattcaaggttactgattttagtaggtggtagatacaagactaaaacccagttctcattcctcttctggtgtttgcttttttatgttgaccattgaaagaaatctgagagctctatatctggctgattctcaagtagacaaacaggagtgaaagctatctgctgaccttaaaaatcatttctttctgaaaatcttggaaaattctaggtttcatctagaatgtttaaatggcatatgctatttttccaatctgtcagcacatttttatcttgattgcagacactcagccccagctgatgcaatatattaggagagggaggaggacaagactgagaataaggagatttggggcccagttctggatcagcccctcttagctgtataactagccttcagaaatagtaccaataatatgtttcataaacccttcccttctacattcacccagatcttcacagttattctcaggtatctaattggaaaggctttaagctatgtttcacaaatgaagaatcaggcttagaaagcactataatctcactgcaaatttcataacaggaaagttgtcccatgcagactgaattcacatccctcaatgaaaatgcatggtcttttctagtccacccactgccttttgaagtgatcaattgatttactccctatggactgccagtttgcagcatttaatccattaggttgcattataaaatcatatctccatctaagttctgagaatctatgatttcctatggttattagcaaggctacagaggataccaatgtagttagcacctagggattcatggttctttatttttcctttctaggttttagataaatatatttattatctataactttttggaggcaagatcaatatttttgaagtaatttaaaaatacatgtgtacatgaaaacatatctaagtacattaatacagtcccagtatctcactttattcctgggtaagttgggggttagaaactgagatagattcctacactaaggtgaagtgtgttgccactactggaagatctggcaagaatcctaatcctttcccaaattggttggtttgtttgccttcatgtgggagtcccggcaagtgatacatttcagatctctatcactttgagcttgtgctcacccctgatctctgccccaccttttgacaccctacttttacagcattttcgggcttttggtttttttatcttttcagtattttcaagcataaaatcaggtttacaatacaaaaaaagtagctttattttttgtatctgaacttcatttttaagttcctatttcaccaagccaattccaagaaaacatataatgcaagagttctccatcgaagcttaaagcaaaaagtatagatatttgaagactaaaacaacaaaaaaagtggagaagaattgtaagttctacctttgatatcccttgtggtctgtcaaaaatataaattccctcaaaaatattttcactgataaaatctggctacattataacattgtgtctgctctagatgattagtggtgctttgggaaaaactattttataatttttatgatgataatacataaggaaagctggaagagcaacattttcagtatttagaatagacttatgccagactacctgggtacagagcctggcttcatctccttttacctctgtaaccttgggcaagatacttaccctgtctgtctgttttggtttcctcattgatctaatcaaattataaataggcataggctttccagatgtttttatggttaaacaagttgatattgataaaacatttagaatagtactggaacataaaaaagactatataaatgttaattgttatgagaaatatccttttcatgatgatcattaccaccaccatcaccaccatccacttctgctgcacagagatgcaatccaatgtttccattcttctaaagtataattattttgaaataagtggtattattttaaaaatagtgaagctctgtaataagcttcactgtttagaatatgaaataaatggtaacatacatgtgaataatgtgcatttgtattatggaatatataacctaactcagaaccttcaattcgaagacttagccaccttttctttccagctgatagtatactgcatgtatagaatgtcttatttgcattgattctagttggtttggtgtcattacactgagtatgtttccccaaggttttagattagaaactactgacaaagaaatattccaggagtcagaattagacataaattatatgctgcagaggtgtcttcttattaccacaagccaggtcagagtctctaaaatcacattcagttactcttttagtggttattaagtttcacccttgagagaattaagaggcctgacaatgaagtataataaatcttactgtgacccaaacacaattagtaattaaacttcccattaacaatcccaaatctgctagataaaataagtagaaaacttatatttttgtttactttttactttcatatttagagaagttgaaaaaagtttcacagatttcataaaaataattgcaatatttgcctgtttcattaatgtagagtcaatgcctcatttatgtgcttgggtttttcatttgagaatgagaatggaccaagaaaagggtgagactttttttttttttaacacatgagcaattggctctctatttttttaatttttatctatttttttttttttgtctcaatccccagcctctgagcccaacttgaaggtgcggtccaggttaaaacagaaagtggcagagaggagaagcagccccttactcaggcggaaggatggaaatgttgtcacttcattcaagaagcgaatgtttgaggtgacaggtaattgaggactgggcagacctatgaatgctgggagtaggaatgaaaaaaaaatagtttagaataaatatacctgctgcatattaaaagttattttgagaagaaatatttcttgaaaggaaattatattgaaaactcacaagtagttcaataaaccttgctatgcattcaccaactgtgttaaacaggaaatgaatgaaaaaacagaagtatgtgtcaatcaaggcataactagggaacaccaaagctcaccttattcttttcaggaacaggcagtccattttgggaatgccaaccaggagaatataatttttaatgaaatttgatcagaaatgagcagagggaggtccaagaagaacactttcccctgtactcagacatgaatgtacaaaatacatctgggaaaattaaactacatggaacagcaaaaccttgacttttcaacaaatttacagaactcataaatgactttatgtgtttactagtgaagtgggacttatggcaggagggggatatattgctttttatgaaggggaagaaactgtcattttcatgggtctcaaatggaagagttatttttttagctgcctgttttagtagaggggttaggaaattcaacctgaggtcttacaacacccctagttccagttgtacctggtttgaaatgaaagacctaaggctgtaagaaccaaaaatactagccaaaatacttctacttactactgttttttgagtacctacttagagtcaggtactgtatctagttgtttcctttggttgcatgaagaaagaagtggtaatctgcaaccccttttttttcccattctcaaggaaaactgtgcttataccaatgtgggcagttggtattagttctccaagatcagatcttatttttagtaagttttaaaaaaattctttattttctgtataactcttttggccatgacagtgtctacaggaaggcaatatagaggaagactgtggaagtggtggtagaaacgtgtatttaggttctaatgcaacctgaaagtttggccgataatttttggaaaataatatttagtctcctattcaatctggacaactttatatgcttatctgaagaaaagtgttagtgatttcaatggaaagtatttccttgggataagaaatattaaatctgaataataaatacaattattttactagagtttatatgtattatccaacattaaatataatcactaatttagacgaattgaattctaagtttggagttacagacttttttcccaggaaatactattgtatgtaagtaaataaaaatcttaggtttttctaatagaggtctttgatgggggtgggcagttgaggagtgaatttgttttaatgaatgtgaagaattataaacctatcaggtgtctaatgtaaatgtagataggtggtttttctaactgcagaaagtaagccccttctaacagcaaaacttctagaaaagacaaaactgaatataatgctattttattttgcttcatagtcttaatgtctgaagtcatatttatttatcccaatgtgcttttctgtgttcctgtagtctgttttcttgatcatagctttttctacacagtcactttttcttccgtaccaaattgcagtggcatttagctcaatacctatctcagtaatgattggttcttatttataaggattatgatttaccagagttttactcgaatttccttaaatttaaaatatatttctcttcttaatttcgtgagataagcactcgccctttcacctcaggaaacaatatgtattggaagagagacttgtacatttattagaaagacatttctggtgagtggacttacggatgctttggtagatatttttaactggtataccgcacttactcgaaatgtctttggaggctccggactactgacacacagctgtcttcacctgtactccttcccattgctctgccaactttcatctagtttggatgagatttgtttggatcttaatactaaatatttttagtatctagtcagagactatcataacatcagagcagttcagttgcttttgctgttatcctcttacctctatgtcttttctctcttccccatttcatagattaaagtgtaagctcttttcaaactcattccactcattgacatgggaacccacttgccatctttttttttcaaattcaagtattttctgccccctacaaaaagtcctgttcttttcaaatgttaaaattgactccccctgtgcctgcaatgccttctctgccattctccctactccaacatccttatttcattggctacccttcttcaagctccagttccaatatcatacactgagatcagagatctcagaaaatcagttgctatcttctcccagatcccatccagtgtcatgtcatagaatcctctggtacagtagttgttgccctgaattctagtgcttatcacagtgatttctacataaggaaatacttcagtcttaatatcataaaataatataaatattataatttaaaattggtaagacagaatgtttaagaaagtagtttttaaaaaatatggaaatggaaatgatatggaaatgagacattaatgagaaatcagtcatattgtaaagacgagagttaggagttgggaaaaagaagctcctgtaagaatttttaaattctacatttcctttgttaaagtaaaaccagaggtgatgattaaaaaaaattaatcaaaatataaaccagatatatagacagaaaggcagtgagcaaaatgtgtttaagtattttattatactaataatttgctcaaatcccacagtaaataagtggcaggattagaattcttacattaacctcacattctttccagtggtactgcatttctgagtagagatttaattataatacaagttgagagttataggtgttctgagagagggtaagaaaatattgcttggaaactgggtgttccctttctctgagggacatacgttatatgagccaggcttggaccttataggtgggattcggcctgcaatgaaatggaaagaaaggaggatacaaaagcatgaactggaaaagtatttggcatgaaaggagaataggtgatttaatttgactgagtgtagagtacagaaagggcaatggtgggaaataatattaggctctattttggagcagagggacatggtgtgagttatctctgtctgatccttttgcaagagtttgaaagaaaggtttgagagactactgtagtgactcagaaatatgagcagacttttgctatagttcttgacagaataacaaggccttaaactgaaatgattgtagtcagacatagatggagagatagtgtaaagatcacattaaaagggcctagtaactaattagatttgcagtaaagagagagtgaggatgactctagggtgatgaaaaaatagagatatgcaggaaacagttaatattaaaatacatacattgagttttacacatatgtaggggagcttggaaggtccagctttcagaggaatttgggctggaatttatgagttaaaggcaagaaatgtgactttcctgagataattctgccccaaaatgacatatgaagtcatgatactgagtgattttgacaagggaaatagaaaagggataaagtcacaaacttaggtgaatgtctgaatttaggaattggtaggaggaagaaaagtcaaagagatgggaagacaaacatggatgtagagaatgccactgtagaaaggatgtggaaaggaatgttttctctgaggccttcaagtgtggtggcatttgagagaacagttgcagttaatagtgggtaagctatattgccaaggcttgaagaagtgagtggacattgtgagagcacaccatttctcaagaattactagcatgctgtcagactagaggggcaattccagtgtaggaggagggcctgaagattccacctaactaatccttttaggatttttttaaggggatgggatcatgggtaagactaaatgtgtgagcgttagagaggaagagaaatgccttatatttgaaatgggaaaagagaatgtagataacataatcatgagtagaaagaaaagatgctggtggaaatcatatcaaaaatcctgtctctgaaaagcatgaggcaagatcatttgtgcagagttgggttgacaaggtgtaatgatgaggcagctaggaagattttgaaatgagtgaagtgtagaaggtggtagggaattaattagagctgaataaataatttgccaaagcttgataagatgacttctctagctatatttctaggaaatggaaatttatatttttgattaaatgttttaataaatgcattagtttctgcataagttgaggtacatgtgaatttcatatctgaagaggaaaggatgggttaaataaagaatctgtcttgttgttgcctgacttttgctaaaaggaatttcttgttatattggtatttacaaatctacatgttaaatttaggcaacttctcattttctggaaaataagttgagtagagttaaagtcagatggtcttgtacaaggtcatcagtgcaatgttgagattttacattctattgtattttcttcatataacttgaactagtatatgcaataataaggtatagccttagtatattaaataaaaaacaatttacagcacagcatttgaacaatttttttcagacctaatggaatgggtctgaacctcatgggttaacgacttgtcttttgatgtgcacaagttcattgtcttcattactgttattttctgtaatagcataagagcaagtaagaaaagattcctttcttcagttttttttttttttctcattcaaagctcctgtgaccctctctaactggatatctttacttctctagaaactgttgaacactatttagtatgttttgccatgaaaacaaaggaggaataagtggtatgaaaattcagagttactgcagaaatttttagttctttctattttgtgaaatagtgcttgcatttacatagggggaaaataacatgcccaatgttacatgttacagtaactaaagttcatctatgtatgttcctcatgaacacatttgtacttcacaatatttttcagaatcctcagtcagtagcagttctccaggctctggtcccagttcaccaaacaatgggccaactggaagtgttactgaaaatgagacttcggttttgccccctacccctcatgccgaggtaagacccttattattttgtttcttttaaaaactgaatttctgattagctacctaatacaaagtgatatttctgagttgaccttcaatatccaaatgatatttatgaattgaagtttactcagttccacatattgtaaaccaattgaaaaaaattgatatttactaactaatgtaaatattataaacctataagaaatgaactgatatttattagctgacataaataaatatcaatttttttcttacagattttttcttatttatggaattcagtaaaattgatcttatttataaatcagacaaccaaagatgtttggaaggcaatctgggcttgaaatgtaatcctcagtcaaacattcttagtgatcctccgtgcacactgcctgacaattatgtaacttactagtccctctgcttggttattggttgtgccgatgtgagtagacacatcagtaagtaaaaacaactcgtacaggcctctcagaggaagaacctagcgaggtggatttttatccatttgaactgaaaagtgatgaaaaataattgcagtattatagttgaagggtgtgaagcttcactgagcaaacattttttgagcacctgctatattcaagtcattttgcctcacagtagggatataaacatggacaagatatgaactctatgtttgaagaatgacatattaaaggatattagtttaaagtaacacatgatttagtgtaaccaatgatacaagactaagaggaaagttaatgtaaaagtcagcaagaatttgtctatgtagtttctgtataaggctatcaaaggcaagagtctgaaaatagccactcatgaaatcacctgttttgaagtcatcaacaattgactgaaagccttatttttgtttctgttattatgccttcttcactgtgcattgctctgtgcaaggagagctggtgcgttaacttctaatatataacatacttcttttgttatattttatagagtcatggtaccttgagacagaaagggactggtcaagtctcttattcttggatcatctccatagcttttctaccatgtggttatccagcctctgttagaacacttctgcttatagggagctcacttcactgtctcctgaggcaacccagttgattttaaatagttattttgactgatatgtctctgtacagctattgctctgtaatttcatatattttatacacacaaacacaatatgatatgtataataaattatttataagttatgaaattatcaggtcagaatataataagtgaaggcagaaatccagaagttgtctctgatgagcaaaggactgaagccagtaaagtcagttttgctctaggcacatttgcacacttgagttttgagctttggttttcagggcctcagaaactcaagagatagaagataaagcctagtaccaaccagggaggataatctaataggagatcctgcaaacactaagctgacaccccagaggcctgtatctatgttacattgattagttgactgcccctcttactgctgtgtcccctgccagccccccctgccctgggctgtctgatgtggaacagagcagagggcagatcctctctctcagatgtcgtaaccacaagctagtccttgtgtagatctgtagcccaaatcatataacctcaagctgttaacttgacttatcatggcaccacatttgtagttcccacgttaggagtctgcacaaagcaaacaaaaactcccctggaggaatataccttccttctagatttcaaaaatttccctcaaataagtttccaagaaacatgagcaaaatatctagatgctgtcgtttgaccattttcagctatttaaagaatagtaattctggcctctacatggtcttcaggtcccgcatctatttcttacttactatcctgttacccctctttatctttttctttatcctttcaaaaacatgatagcagatggaataaatactttgtttatatttgcagccagagacataagtggagttattgggttattagttgtagatagcatctttttgttagtgcagttatatctggatattggtccattctctgcaactatttagtaaatttccaggaaaagaacaacttggttacaattttttttttcaaaaaattttagattgttgttatctctcagtatgaagagtgtaattcttagtaactgcaaaaacagcaaaggatctgggttctaatcagtccctggatggattttgtgccattgaaaaatgaaaacaacacactagactacattcagcagcatgtatgattctgagaaatgcattgtcattgcaatgtttcagaagaccacttacaacatgggaggattttattaggttcagaaatggtaataccatactttgataatatgtagtaatagtatatttttaagaggcgagagagtgatgaacacaaaatttagcatgatgattacctttcaggggggaagaagggggaaaacatgatttgatagttactaaagaagatacatatattccttcattgtaaatacatatgtatgtgcatatagtatttagtacaacatattggaacaaccagtaagtatacatcagtgaagaaagtaaataaaagattttgcttatactgttttaatctgttttatatttctaaagccataacttggcacaaatcatctgtttaggtaccctagcttttcagctaattgttgaacatattctctcactgcaaacctttcctttcacccccaccattaaaaaaagaaaaacaaaacaaaacagagggaaatgtgatttaatggagtttaaaagggtagaggtatttcttcaggtcagtgacaggacattcacctccaaatctggaaagacgagttcaaaagcaagcagtgacttacctcataatgaattaattgtgtgcctgaactatgatccaaaaggccaggtgggcagacctttatgcactgatgagtagcctctctgtggcccagaacaaaaaatgcaaccctgatggctaacatgtggttttctgctgtattgcatttacagagatctatggtgtaattcattctcgataggtgaggagacagcggaatttagactaagactgtcagcaaattaatatcctagctttttagcactaaatgtttccacccaaactggagaaaagaaaaaaaaaatttcttagccatagttgagtaaccatcatttagaatttaggatgatttttacagatgtctcctaagattgatagtagtacgggatttcatagcaacaaatattttgggggtatgaattatttgcataatatattgcactctaaaaaaatggttgcatactttaccgtttacaaaattggcttattttactgtttttgcttaagcaacactggtaagttttcgtattaaagtagtgtatatttgaatgaagtctttattttatggcctgtaagtagaaaagcatgtcacctaattcagagcccatgtaaatgaatgggattctatcctattgtgctgcttcagaagtaggaaagtcaggctatatctaaagatcttgagccctagatgaaaacaaaattttctatcttgtaattcacatgtcctgcctaatttagataaagggaagacagaagtaggaggagaatttactcataaattgaggttcaggaaatagcacattgtagtagaatgtatgggtgttccattcagaagactcagcctgaacctggctccaaaaccggctaccttgtcatcattggtcaagttgtcagacttcccctgacccccagattcctgatctaggagaaggtagtaccgtaatacctacactagcagctttgttttaaggaatcagtgtttggaaggcaggtggtaaattgtgaagttcggaacaagttcattttttgttgttattatcagcgctgactcctggtagggaaaactcattagcatgtttgtcttcaagccagcagctctcatgtgagagtgagtctccatctgctctgaccacttctgttccatttcttctatttcctacatatgctcagtcccagaactcagattgttggagctacttgctttactcatttgtaaacttggttggggagctgaaacctcaggggtttctatttccaactccagtcaaggatgtctttacctatctagttactttattgttaatactgtgggcctgtgggttcaaatatgtttccatggatatcaacactattactttagattcagtagatttatttgatagctattttaacggtagccaagctgctggtttatttctagttgaacattagtggctgtctctgctatgctattttttaaaataaattttccagcagatacaaatgcttttaaaaaaggattctaataataaggttaagtgttctaaaatcatctgtaatgtcacttgttttgccccaatctcacatgactcatctgcctgttgtttcataatagttgttgtgacatttgcagtaaatgttatgctcccttctgagtgggtgtagagctgtggttttagatagcagcaaataaaacacgttccccccacccccaattcagggaaaggaggttgctatgacaaaataatcatttactaggaataacatgagtcaatattttaaagtaagatctttaacaaaacatcagtgcctttcaaatgctaaggaaactctgtcaaatgatctttctttttttgttttttgttttttgttttttggtctcacaatatgtctcaccattttatagtaacaccttctttggtgtccagtaaaatgaaaacttgagagatttctactgcttcaacaatttttttaattacgtggagattttaattttctatgagctatctgaaagaagagtagaaaataaatacaatcttgaaaaatcccatgaaaaccataggcaaatattaaatgattgaggcttttcttttttaaaacgtggctatgttctttttagatagcctggattcagggacttgggaccttgtaaagccaaagctgattgacactcataaggatgtcttcctgtatgccattctaatagacacacatgttacctgatagagctgggcagaggtgcttcagtctcaggctgaaggttctgaagtccagggaagttgggtgctgcccagggttacaagctatgagtgggagagctcaagtataagacacttaggccagacttcgtttcacaagtccaggctgctcctcaccaaaattctgtgtgtatatatatattttttctttttctgattctcatgcatattgtagataatttggaatatacagtaaactgaaaattctatatccacatttctgtgagctttttaaaatgtgagtgattactggccaggcatgggggctcacatctataatctcagcaattcgggaggctgaggtgggaggataacttgaggcctggagtttaagacgagcctgggcaacatagaaagaccctgtctctacagggagaaaaaaaaaaacctaacaaacattagccaggagtttgagcccaagagtttgaagttacagtgggccttgatcgcaccactgcactgcagcctgggcgacagagcaagatcctgtcttaaaaaaaaaaaaaaaaaaaaaaaaaaaaaggaaaagtaggtaattatttacataactagtataactagcattctgtcaagggctatcattgacttttttgtcttcttaagagtaagaaaagtatttgtttatcttcttctctttcccttcctccttttttccctgcctccctccctccttccttggttccttctctccatctcctttccccactttcattttccttgctcctggaggcatcattctctcccgtgttcttgtttatatgaatttttacatcatatatattttttactttgcatccatgagttttaatgggatataaatggcacaatgttatctgcatcattccattttcttgcttttatcactaagcctgtgtttttacatccagacaccatgtctttatggatgcagaagtccaatggtgtgctttcaatcaccacaaaaatccatcgtgggtgctgccgcgtactgatgccccgaggtagatgtcctggtgcccttcaatatataccatggcccatcatcctacagcttaatgagataatttctcgaagttagaattcccagcaaagccatcactgggtcatggtatacagaataattattttggtttaaagttcagcagaattgctgtaccagactactgtcccaccagcatcatatgagagtttttacctttctgaatccctgtggcagttgacattgtccatttttctaattatacccagtgtcccttctggaagacattctcactcttttaattgaaatcagtggcttaatttaaattccacataaatagctctattgagaggcataatgttccagtccatgtgttttgtattcatttgaattacaaatattatttatgagatgcccctcctattgacataacaggagagaaattaaataagattttgaagagccttagtaaaatgtgagtaggccacccctaccccagcacttggcccatttcatatctcatgtcccaacataatgctccttcctctaattacagtaattatcacaagtcaaagaattagctctttacttttctgtgcacctaactaccatgtgaattggtgttttataggacatctttgtacgccttgcacccaacaccattaatctaagacagagaagttacccgttaattgttttgtgaaggttaaacaatagccattcatacatttactatattcattttatctaaccacaataaaaatctttggttctgaaaaattttcagattaaaaccgtcatttccatgttctaaactgcaaagtattggcatcatagcaaagcactgatttaagggctgggccagattcaaaacttcttcttggaaaaatcttggctttgtctgaaaacacttgtgagctcactgcaatgctaaggtgggatggtcttccagccttgcaagaatgctagtcaggatctttcattgtgtcaggtgaatggtacccctcccaatctgttagtctgactttaaagtgtgtctgtactcaattagcagtgtagactatggctccaggtcttattaagagataaacgtggaacagatagactgctccgatcaaaaagcatagttgaggaaagctgtatttaaagaaaataattcaagggaaatggtttttcatttctctgaagtcatcctagaccttgaaagtctacataaatgctatgcctgtttccttatctgtaatccaaggagataagctaagcaatgtcccggtctgtaaagtttctatgaagacgacataccagttaagagtctttgggaagaaccaactatacctagtagatatgggggacacagaaccatccttgcttcatcaagaattgtctccatgacttgaagatcctgacatttataaagtcaccggagcttttttcttgtgccaagtcccctgactcccagttgcactcctttattcctgccatgagcttcagagcctgagtttgcttcctcttctcctccaaagccaccaccattctccctacttttctgtggttcccctgtcttccagcagtggctgcagagtcatactccctgtagcagcagctgtcaacaaatctcatagccttggtcagtttaaaggttttgttgctggtcccacatggaagcaaaattggggaaatgactcagtttcctcatcgacagcatgagcataatggtagcttgagagtgcctgtgaagaataggttagcctccaaaaaattctggcccaggacaccatggtaggtgctgaatatcagtacactgccagaggaaatggagccactcaagttttataggaaactacaaagatctgcaatcccagagtaagactgtccccaaatctcttcactgtagtcaaagccagtgtgaggagccagtgtgttgctgccattattacgtctgagaagataatctatttctccttttagtttaagtctggttcctgtgatgaggtgggaggatatcacagaaattctctctgggaaacaaagaaaactcttttgtgaggtctatggtattttttgtgccattctcccagtccgtgtcaaatcccctagtccatatcttagtgctgtgagaagcagatataaccttgaatgaatattatgccctatttaaaatgcttatttttccacacttattttctcttcaatgaatacagataagtgaataacatatccttttattttaaattactatttactgccaataagctagttaaaatatttttacttccttatatgttccttttgttcttgtacaggtattctatacttacaattttcgtgaaaagcttattatttgtatgagtaaaagagtagcttgcctttttgtgtacagcaagtatgcaactctgtctgatagctcataaaataaaattgcaaccccacacattgtaattttaaaatctttcccaacaatcttcatgctatgtcacttagacaactaattttttaaagggctgcatataaagtcaatgtaatgttattgctttcaacatacctcttggttttcatgcacaaatatctgacatgttcctttaagaagtaacaaaatctgaactagctttgagttccaagttgcaatgagaaaactccacatttaaccttgtgctcttattatgttaagactaagactcatctccaaacaaacgtatgattgagatgatgttttggaataacatcctgtgttttggtggtgcatcactcttcagtgacattctgaggttgcattgtatcagcacatgatattttccccggttaattgatatcccaggtttgtccaggggaaaatctacagctcccccaaacatgcttgacaagttattatatttactttagtcaaagcccgtgtgtgcaatatccctcttggaggtggtctattattggagtcccatatgctttttgtttgggaagaaagcagccactgtgtcatactgttacatggagtattctttttcagggatgttgttcccttggggaccatatcaggccagagttccttagtctaataagacctttgtaactcttattgtataaaagttctgggagggaggcaagagttaaacagaaaatgtaattcaagcaaccatattaggccacatgtgggaaaacatgactcttagtaatggattaaaaaaaaggtatttgttgtaaaaagcacagtgatgccaaaacgttcagggtatttcaatgtaaatgaagcctactgtggcataggactcataacattttaacatttactttagtttctgaatatgaatgatctaaaaatacaccacacagaattgtctattcataaatgtttataagtaaaaaagatgtgattactatggaagccctatatggtgatatttaatctaagatttttcttgggtcagttttcccatcaataaaatgacattaaatgaagaatcaggtgaagataatgactgtggtggcattatatacatatttttttcactgagtaatacaaaagaagtagacatactaatcagaattatccaattttatcattgtactttatcagcagatgacaaacatgctgaccatattttgtatagccagaattttataaatgaatttgcaaaaaatgaacatagatgccttttattcagattttataactatgtctttggaagaaattttttatttaaatttgacattataacttttggatatagaagtcataaaataaatacttaaaatcttttcttaattatggtaagacccattttctgaaatgagaacattttacagtaaaatttgtgatactgtggtattttgagactctcctctttttttaacagcaaatggtttcacagcaacgcattctaattcatgaagattccatgaacctgctaagtctttatacctctccttctttgcccaacattaccttggggcttcccgcagtgccatcccagctcaatgtaagtcattgcacagcatcagccttaatcaacctaagcaatatcttttcacaggggaactctctttcgtgttttatgtatttagactttagaaaaacttgacagagccagcatctccttcactgtttgctatttgctgtgttgttcaaagacattcagtctaatttcaagtcagaattatcctggttcacataatcatatgtaaacataataactaacatttgtataatggtttatagcttttaaaaaaaaagcactttccagatatattattttaatagctccacacagccatcctgtgaaacagagattacagcccacgtttttacagaaggagaagctgagacttggagagtttcaaagcacaagatcacagagccagtaagtggcagacctggaacacaagccagggcagtgctgagagctacagcttcgaaagcacagcagcatatgtttatagaatttattttgtgaatgagtttattttgggaatttaagttactgactctctggtactggcgaatatgtatctggaaaaactctctaagaaaaatattaaactattcccagaagattcaaagtgaatcaattagtttaaaagtcctgacaactgaaataggctctttcgggaagaaagcagtcactgtatcatactgttacatgaaggcctagaagtgattccttgttctggactctttgccttaaaatttcctagtactcagcagagaaaatggaatactagagatctctttgccaaagcagagctaaacttgaaatgttattgtcatactagcagaagatggcaataattattctaggcatattccctgaaacagtgtcaattttagttgtaaaaaatgtgtgggccttatccagaataattcatctctgaaatgttagttaattaaattgtatatatacaggggtcatatgatacattaggtttagagagaaatttattccaactctcatcaccagtttggccaatctttaccttcaagtcttccactgagttgaatgtgtcaagttcacttgtatgttcaacacatagtttcaatgcgtattttaaaatcaacctaagagatattatatctggtattgtcaatagactataatgtcattttatgtggtactgtgttcttataccaatgaggaaaaaacaaaatttggatgttgtcttatatctggggattataaaagaaagcattgaaaatacagaattcagctatgctcttaaaattccacatgaaacatttgtaaatgaaaaacaaaaaaaggaattaggaatgaaactaaaaataaatattcatggataatattttacagttatcactaattaaaaaatatttttccttctctatttcctgtctcttctaatgataagtaaataccaacccaaaaacttcttatgacacatgaataggcattttatttttacttatttttgtatgttctaagccactcctctcaataactcacacatggaccacttttaatgtggtcagggaaaattttttcccaaaggaccaagtactaaagccagaccagttaatgtttcagaggtaatacgatttggtaccattggatgaataaaccaatgtggtttggattaaagtttcatttttctttgcttccattttggtgtggatgaggccatcacaattaatttttcaagtttagcattgctttgccaacgggatttgtagtactccatttctacattgaatactgggaaattttaaggaaaagaggccaggacaaggaatcacttctagattaaacattgcattgacttactgtgtgactcagacaaaccacttacctctttgtccttcagtttctccattgctgaaaattgcttcgcctccctggtgcacagcaattttgaaagatgaaacatgagttttgaaaagaaacatgccacataattttgaggtattagagtcctgcttttgtaatagcaaaatgaccaccattcattaaatcctttgaataggataattcattattgctattgatgatataattattattgccttattactgtgttatcatacatttcaagttcttaatagcattttttgtagtttattatacaaaatatctagagtgtcattttcaatatttagagatttgggtatctgttatgaattaatataaaatgtttaaatcaaatttctgcatatttttacctcctttcattgggttattttaagaatttaatttaaaaaattaaacattggacacttacagctctgtgaaattattagaagccatgtagagaaagggtaaattgttccttttgcttgcaactccaaaattacagtccatcttatctccagcttcttaatccccatgatatagtctttgaataaattttacctctccagtatgcctttaacttaaacagtgtataaaatattttagaaatgtactttccacttattaagcctgaaataagcattttttgtttttttattgacatataaaaggtacatatatttgtggtttacaacataatgatttgacatatgtatacatcgtagagtgacttaagctaattaacatatgcattgtctcacatacttattttttatggtgagaacactgaaaatctattctctgagaaattttcacatgtacaatatattgttattaactgtagtcatcatcatgtacaacagatctcttgaatttattctttccacctaaaattgtgtatgtagcatcacttctgattttaattataaaacctttttatgttcaatacaatgacaatattaaattgtcttcagtgctccaaccctatttttattccttcttttttgaactgagttagtttaaaaagtccattttccctgctcagccattgggtaagatggggcttttgttttgggaagctacagcataggaaacttgtctaatgatttagagacccagtgacccacatggatgaaagaggattaacatctttgttatttctcaacacaggcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtaattcattatggcaccatttgcaggtcattttagggttttattttattagtgatccaggataatgtctcttttactcaagaccctgatggagatccacagtgctatacaaaagtttccctgatacctggtactgtgggaaaggctatcatctttatttattccttcagatccacttggggtaggaggactcacctcatttaacctttattcataccagactaggctgtggtgagtcgtatggtcagatgcgtacctgtccaatgccttgacatttctctcttcccacacctgacctattcttctgttgtttgcctggtagcatcactaattcactaattttcttacagtttataccatgtatctgttttctttggcttcttatcttttcttaaaattgtgtgtgtgtgtatgtgtgtgtgtgtgtgtgtgtgtatacacacatatacatgtattttttttttcaggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaagtaagcctccaagccaagtcaaaatgttctaaccgccagtttggaaattgggtatctcttcactgatatgggtgtctaagaggaatgttgatgggagtcacagcaaaaaggatgtgatcatcctaagcctgctttcttggctcaaggacaccatcacaatatcagtgttttaaccaccattatgttcataagacatttgtagcaaaattgagatgatacattcacaagatctttttatgatcaggtatatattttggtacacaagcccatacgggcatatgtatatggagcctcattttttagtgttgcagaaaaagtttgaggcagacttgaatgtggtgtgttgacatgtcaaaaagtttgtacaggtgatgacagataggccaagattagccagtaaggcacttctcagcaacttgtatgcatctacgttacatttattttgcgaatgccccacttcattccaataagcgtttggagtagtttctcggaaacttgtgatcatttcttcctggaagtcttaatgttgctaaaatagacagcggatgtctgtaccgtaccacatccttaggagctctcctgctgaggcaactacaaagaaacagtgattgcagcataatatcagacaggccagtaaaggattttctatgaattcgtaagcaaaatgatattaaagaacctggtctggacagtttttccactactttttgctgtggtaggcttaaaaaagcaccatcttctcattcctggaaaattcctggaaaatattaaggtcctgagtattaaaattctattcccttgcctttgtgctgtatcatctacaagttatgttacagaggcatgagaggcatgatattgcaaactgatactttgtttactgataaatggatagctaaaacctggcttagtaataactttgttgtactatgatgtaagaaacaaacaaaacaaaacaaaataaactctcatgggcagaggcttaatcatctttctaacggcagtaggggaaagggatcttcatcacttgctggttttatggcaagtgttgctggagtttttctcttcttttggcctccatcgtaacaagggcagagccatgaaggaagcatggattggataccatgcttccgaacagaaagttttccagcctagcccttcgctactctcaaagtagcaaaagtatgtgtgggattggggtgctagagatggggtggctggcagggacaactctctctctaaccttttagtatgcattgcagaccctttctgtgtcattagataatgcctattttattgctgtagcacttctctaaatttagcaaatatttcggtttcatatcaaattattttatatcaaatcagtatcttcaggagagagccaatttccttctctgactaatggcataatactcactgacttgtatgtgactctgcatatgttttctatattatggtagagttaggtttgtttatttgttttgtggcctttcagcacaacttaaaattattaggtattcttgaaaaattgtccactgtttagtgcaagaaatgtatgtgggagggaagattagggatcgtatttttttgccatatagtgttttgatctagaattaggtttgtttataaaaccagtattagatagtagatagacttttctgctatgcttggttctatttcctagaaacacatggatgtatatattttactatggtaaagtaggtaaattactcactttgaaattgtgatccacaaatggtttctatgaatacctttaagaatattttggaatacagttttttattaactaattgccactgtttcagattcagatggtgtgctaatatcagaatctttccttttcagtatcaaactcgagattttgacaggcgaatgctaacctcagtcacactggataaaactcagatgaaaagcaggcatttgcattttagcaatgagaaaagcaaatcttatcagagaccttttcccatgtggagctgattcctttgaatctgttaagaattcttcccagaattagaaacaaacctatacttttaggtacatgtttgtacagtggtttgattattaaatcttgtcttaattaggcaaaatgaagaccagaaaacttcaaagtccaaagctgatctttatatgttaacctctctcagcttgggtgtttagatgactcaagcaggtcgccagttggcttttctccaaggatgtattccatatgtttcatcaagttggcatattcacgttgggtattctccagattttgaaaatattttacctgccctcagttgtctaaggggacagagaggaagcttattaaagaaaatatcaaacccatgtcctatcctgaaatattcacaatagaacgcttaagaagtgagtggctactgttcacctgcttccgtgacgtgacaaggatgtttatttcacattgggtcagattcataacttagatgcccaaagctaacatgtttctgtataatatattgctgtatacttgatttaaccatttagaatgcccattagtaagaaatcaccacagaaattttatcatttttccccatttccatggatgaacctttatgaaacccattcatactgaagcgatggtccttactcttgagatacttatagcaggaaatacaggcacacatgaagatgttgacatacaaatgacatatttaaatatatcttcttttatttcctttttatgattcttttttgaggaatttagagaaacaaaaaatgaagtgggaacaagaaaatataagtaggattatttctaaacctgtatcagattaaatatgatgggcttcctggtataaaatttgtagtaatgtgtttgaattactaataatctttagaagaattagaaacaaagctatatagttttaggggcatgggtgatgcaaggattgacttattaaatttgaaagagtttttcatatcttgctattattttaatgtgtttataaaatattcatgttcagtgtaactacataatgtaactgttattaatcatacaaaataatttacctacttgttgccttatactttaatatcatatttgggatatttgtgggatagttgtgtgttctaagattatttgcctcttacagttacggtgtaagtgttcaagggcttagcagaaatatccctggaatgggcttgtatagtatttatactgttatatctgccagtaaataatggggaaagtcagaaaggagagtgctgggctggagaggaaaccctgtgagaatgatttatctctgctcatgagtttgaatattctatttttcactgaaactgttttgagaagtttaatcataaagaaatcaaggcttacaacatttgatcttttgttttctgagacattttacaaatcagaaatgcattaaacaggttctattgctaatatatggtattaatatttttgtgcaatgatgtcattgcacattcatttatatcatttttccccaataccatggaagaaccttttcaaaaaatcaagagtttctttataccagcatcaagggaagactgatgcttttgccagtacaccttgcttttctgattggaggaaaaaagagtttctaaagtagaacttccctcaaatacaaaatatcaaacaaaaagtaataaggtattggtaattttctcctgggcccatttcaagtttaaatattaccacaggattttttttctggtgaaataaaactgtaattgattaaaacagaatacgtaacagttgtttagacatactgatgattttaaagaagtattctaagcactgcctaaaaaataaaagggcaaatctctagtcacttcactatttgaatgatatatagaaaattttcaaaatctctttaggcatttttgttgtgaggtaatttgacatagatctctgccatgccccatccccttgacaacattattctttatttctctgttatagtattaatagaattgcactgattcatgcctagcagtttctattttaactagaatattaatatctttattaatatctgtttttcatattcattccattaaatccataagagcaggaattttaagaaaattcatactttgtttagtagttactttaatgaattattaatctatgtatggatgcgttaaacaaatcattaaatactgtgtgcagacacagttttaagcactaagaaaacaaccttcagtgtcctcatggagcttataggatggggagcaggaagtgaattattgaaataaacagtaatacaggccgggtgcaatggctcatgcctgtaatcccagcactctgggaggccgatgtgggtggataagctgaggtggggagttcgagaccagcctgaccaacatggagaaaccccgtctctactaaaaatacagaaaattagccgggcgtggtggtgcatgcctgtaatcccagttactcaggaggctgaggcaggagaatcgcttgaacccaggaggcagaggttgcagtgagctgagatcctgccatggtgctccaaacctgggccacaagggtgaaactccatctcaaaaaaaaaaaaaaaaaaccagtaatacagtgtgttaagtattaggaaaggagacataagaaagaaaactgatatctttaaggaaataaaatttgagttaattacttctctggattatcttgttcttattatatctcactccctttctttttctttcttgcttgctcgcttgttctcttgctttcttcctttcttatatgctctgtgataaatatcttgtgcattcctatgactggctatcagccaacacttttttaaaaacttacataaatcatgagatgatatcttatatatgccaaggttcggtctagatataagtatttattatatatttattactgtgatacttaggcattttgacatgagtgctattttatcataataaaaatatatctaagacaagaccagtaaatgtgaggtcaagcagatgtactgtgttgcccttattaaaacaggtagatgttatgtttatgttctgacaagcaaggcatgaatataattatgctcaaatgctggatctgagcaaatggagagctttcattagcttttggaagagaatttgactgtttatttgagtagtatctgtattattccttttttgacataattttctaacatgaatgttatatattctctgaaatcctcttgatttatacccattccctgtccccaaccctccatccacagtaacctaagagagtatattccttcatgcttgtggtcacatacaaacatagcatgcatgcctgtgtgtgtgttaatgtgttgccttgtgaagtgtccctgaaggcagttataatgtagaactattttgtgcactattgaaaaaagtataagttttgagaaggagattaattagaagaacaattctttacatgtgtctgtattccaaaagtttacatttttttaaagttatacttcatattctcaaacagatactttatattagctgtattctaatgtaattctatccatggcttacttgtaagcaaattaaatgttaagtataattacacaagggccatttacccacttttgactttttgctgcacctacttcttctagtgtacctcttcctccccttgttttaggcactgtgcatcttttcagcaccttctccatagataccttagggtagggtcatttaaaaactatcagctcacttttatatggaggatctactataagctggactccataccagaattcttacgtctatcttcccttcaaccttaacaactcactcttttttagttcaagaaaattaattttacagggctgaagtagattgagcaaggtggcagggctagtgcagagctgaaatcctaacataggttgtatgacacaaaagcctgtccttaatcatttgtgcttatgattacagtcttattttatgaccaagcaggaaaccggcttttcctaattttatttttgtctaaaagtagaaaattcacagttaaaaacaaggcaaacaaacattaaaaaaaatagggtgatcttatttttcttttgcaccggtttagatttgccacgatgaagaaatcccctttcccagctctgcctcccaacttcacacacattgacctccttcaagttactcacttggcagtctttgcacgtggacctgacggtgagacattcagatatcctgttggattataaggctttccaaacggtgcagagtgaatgcagtacagagccaactacagccaggccacatttcattcctttctcgcatgttgtcacattgccgttgttttagattggacaaacatcttctcacggaagttctgggcaagcctgaagctggaagttaccgacttcatcaggttcaactgaaatgcaaatgttggcatctcatctatgggtggttggaaaatgccttgttttatgttttgaaaaatggatgagtagaaactggaactgggctttcatttaggaaagtaggcattagtgttgtcaggtttaatttctctccatccatttgacagcttgtttccatgcagggtcttttaatcaccaatttaggattacattttgcccattacatggatagtatgtccaaaaactttagcaagcattgaaaggcagtcttaattttataacagtaaaaagcctcctagattatttatctatctatagaggtttataaaagaaactttgacgttacccttaaatcgatgttattctgagataattggcccaatataaatagattcttttaaatacgtagtactaggtctccaaaaaaatccacttatagaataccagcttatatcatcacaaggaattcatatagatgtatttcactatataattacaagttgatggtttctaacatacagaaagtggcttgttgctttattattagatgtgatgaaatcctgtgtttggaaaagaaacaaaatgaccatttcagtggattaatgtgcagcattcataaacattcccagtgctgctttcataacttggagaccaagggaagggacctagacctttccttttcactctgcactgttaatctagtcagagacgcttttattgaatgagaaaaacaatagttggacatgactatgaggtaagaaaacggggggaagaaaaatatctggggaattaaaccacgtgaattgtttgattgatgttgattccaggcagttcaaagggaaagggaagctaaataatttggttgtttcccaaccttgacaagtagtttcatgtgacagaatgaaaaaattaggtcttgctaaggaatttttaatatagttaagtgatttgtagacatgaaaactgccagtgggtagcagtctcttttttttttttttgcatattttggtagcttgcaagttcctggttttagttcttttttcctgtatctttcagctcttcctctaactacttatgaaatctgaggaactacagtgaccctgaaatgtcatctggtctagagtattcctcttcctgcaggcagaattgcatccagagctattctctcatatcttaaatgtactgctgctctcttgctattaacctagttgtatcagctagcaatataaagtcctgcaacagtctccggtcatggaataattgatgatgttccacaaagacttatctattaacaaccattacacttcattctggaaatgaaaataaagaaggcatgttctttcccttgagtggctcaaagacctgtaaacagatcattataatcaaatatgattctatcaaatgcatagctcacatgaattgcaaaatctatcatcttgatagatttttcaagagaagtttctgaggtcttgcacaattatttgttttgcaatattggtcaagatattcaacctttttgtttaataattccataaacagcaaatttttgaggtttacagtgaggattacatgagagaacatatctgaaaatgctttgtaaacatgataagcaccactaaaatcttatacagtatttatattcttccaaatcttagctattgtggacagtgctgtgacaaacataggagtgcagatatctctttgatatactgatttcctttcttttaggtatatgcctagcagtaggattgctggatcatatggtagctctatttttagtttcttgaggaacctccagactgttctccatagtggctgtactaatttacattcccaccaacagcgtacgacggttcccctttctccacgtgctcacctgcattcattacgggtccatcttttggataaaagcattttaactggggtgagatgatgtctcattgtaattttgattttcatttctctgatggttaatgatgttcaacattttttcatatggtgttggccatttgtatgtcttttgagaagtgtccattcatcttttgtccgttttaaaatcagattattagatttttttcctgttgtttgagttccatatatatcctggttattaatctcttgtcagaggggtaatttgcaaatattttctcccatcctgtgggttttagcttcattttgctgattgtttcctttgttggtcactgtgtttaattgggtttgccctgctttccagtttaccaaagtaaggaattgatcaatgggggaaatggcgatgtttatgagttgggagagagtgattcattggtttgagattttgtctattctgagacccattcccaaatcatcaatgattagcaaagaaaataaggatgcctttccacactgtgcctctattttctactcttaaagagaaaaggaggaaaacttgggcagaaagtatactgtcacctgaaggatcctaaagattatcagggaaagaatcctattaggtaatttttaaaaggacataaaattatgcagtgctataaaagaagggaaaactgcttatttttgtcctagttaagaacactgccccaacccctgccaagaaatcttggttaagaattccacactcttgctgaggattgtatgttttgaaaattcagtcttcctctttctacttttgctccctaaatccagtcttccatagcagccagaatgatcatttcaaatgcaaaccaaatcatgttatggttaaaacaccctacttgctccctcttgtttgtaggataaaatccaaacacttttacatggcctacaaggctgtcatgatctgattcttgcctcctcccttgccttcatcatctcctcccttccctctctctctaggctccagccacactggccccctctcttatctttgaggaatctccttccacctccaggagctgcgccagccactattttgtgtggaaggctcaacctccacgtcttctcacggtttgattgtgttttggggtctgtctcagctcaaaccttacctgttgagaggggtctttattgcccatccaaacaagagtaaacacaaacacccacctgctcaccccttctttcagctccctatcacttcgagtttcatttttcagttgctaattttctgcctcccctactgtgtgctgggatcttgcttgattgacctttcttttcctaaggcctggcatatagtaaacgctcaataaaaaattattggaagaatgaaaaaatgggtgggcaatgttctcaaactagttggaacaaaccttcagtttccttcccagaagggaacacttattgaagttactgaaatattagcaagttttgagaaccagaggaaaaaaaatttaattgcaggcattgttttggacaatcatttagagttaaaaagatgaagcagcatttattaaaaattcacttcatgctgagattaattttgaacctctttaatattgcttagaaatggtatttttcagtttagacttcaatttgtgtgaataatgaaccaatatttagaaaatctttcttctcttgttatttaattttggttcatctgattacttccctaaaatacacagaagcaaaatgacatggagtattattttggcttgaggttggagttctactccaagtagacctctcaatttgaaagccctccaagctctgcatgttgttttttgagaacagttggtccatacctaatctatttgtgaattcaaacagaattttatcattatttttaaatctagtttccttggagcttaagggaaatgttttattttccaaaggaagaatattacatttatttaaaagaaaaaaaaagcaaaaaaaaaaaaaacaaaacaacaacaacaacttctgctattgccattccccaagtacaatctgtcttaaaatctgaggcaaaataagaaagtgatgagttgcattgaagttcactttgcatagtttaataatcatattcaaacacttgtatttaatggtatgttgacaatgtcagaaaatcagatgtttatgaggaacagatttattcttacatgatcctgttcttagttgatattttgtatctgaagatatttgttgggatgcaaaggatttctgtgggaaacattaaaattatagaatttaagcatattttatttaaaagtacatatgcttatagagacttatagacttgtatcaagttatataatttacacagaggtgaacttaaagtgctaacatataaacattagtgacagtctttaattattatttagtgaatttttcatcatgtgccaatagaatatatgatgttaaacatggaatgtgagattctgaaattaaggagtttgctataattatgacctgagcagggattgataagaattgaagtttagttgtaatccttgaagacttttgaaatttggataaattacgatggtatctggcacacagaacaacatctgtttgagtatatgtaagtgtgtgtgtgttacaaactcagaatggtcataggctgcccgtggcatgcttagtgttcggcccaattgctatacagtagcacagagaatagagagacagcctgacagatgagtatgagcacacacaaaaggcaaaggagaagctgtgcagctgccctcttcttcatctctgctgggttccccactgaagtaactcacctggtgtcagacgagtggcacacggtgtgttttacagatgaggcctcagcagagattcacacaggcttgcacatttatctgtcccacagatgtttcgtcttctgttatctagccaacaaggcaacagctcgactttgctaggggatcacctccagatgttcaaccaaagagagaccctgccaccccactgagagtaagcagacatctcctcactacatctggggccactcagtgacagtacaaattagaaaagggttagcccataccagctttgcagtggtcatatttgtagttgagaaacacatagaaaacaaattccaaatactcattttcctagtaaatagtcggaaatttacaaatagcacaaagtaacttttataggaaataattcaaatctggcaggcaagaatttctctgtgacttttgtttgtaagttttccttgctgaagttaattgaaaatttttccactgtgacaaatttgactgtttaaacaaaaacagccttagtcagatacctaaaataagaagtgtagattaactccctttctgcatttatattttgcaacactggcaccggatgtcccatttgtcttttttgtattttgtgaatctttacaaagagcatattttattccagagaagatgaaaaacgggtagttattgctcttttagacattgactttgttttgtaacgtaggagaaaaagtgtcaaagcattgttactaagcattaataattttttcagaaacttatgaagctccaattaggtgttatgcaatgtatcaggtactaggatataaaatgatgaaaaacatatagcttatgccctatgagatttatattatagtctgggagataactatattgtaaacaaagatagcgatatgatgccagacaacaataaggactctaaagaaaatatattaatgagataataacagaggtaaaatatgataagaaggagccagtcaggcatgtaaagatttgagggagtagagagagcacggcgtagactcaggccttgtgggcgaacaaactctgcatgtttttattcacggggcaaccagaggccagggtagctggagcatgtgagaaagagagaacaagatcccaactaaggtcggagaagttggtggtgccaggttgtcgaaagtctatggaccatggtaggaggtttgaattttattataagcataataggaagtcagtgggggattctaagcagagaattaatgttacctaaattatattttaaaaatcattattagagctactgtaagagattgtactgttgagggccaagagggcaatcaaggagcccagagtagggcctttgggtagtttagggtgaaaatgatagtatttaggagcacagtagtagcagcagaaatggagaaacatgttaagataaagcctttatttttggaggttgaattgccagggcttgctcacaaattaaatgaaaaagatgagtgatagagaaacaaggataaatcccaaatatttggctcatgcagttgggtaaagctgtttactcaaatgagaaagattgggtgatcaatacaattgggttagatgggaataaaggttatttttgaggtgtttaatgtttatgatgcctattagatattctagatctaagaaaacaagttaagtacgcagctaactatgcaagtttggagctcaggggagagattggaattgctcctattaatccagttgtcatgagaatatatagctatttcagagcaaaatgtggagtagaatggtataaaaagttctaggtttctactctttttttttaaatcaaattcatatcttacaatcttagagatgacttgtcttttttgggcatgagattccttatttaaaaaataaggtttttaagaatgttattaaaagattttcaagtccagcattttatatctatatgttttctactcagaagttactgttttatatcaagaaacatttcttttacaaaccatgaaggaattctgctcttggaaaaagatcacaacgttatttattctggcttttttcttccccatgtttcctttgatagatcagaagtgtagatgaagccaaagaaactgaccggaacaaatagaattatttctgtattgcatatcaaaaattgttatatatactgtcatatgcatatctgtgtcagtgaggttgtaaatactgaccagatttgattaatggactgaacaatgtgatttctgggtacttcagtgacttcacaggtcagatttcagaaggtcttctgttaaaatgtacatataatacgttccatggaaactcaggggtttgttaatattagagattttccttaacttgctaacgatgggaaattatattctagtaaattaacactcagtttgtctggtctttggctgcagtggtaataccagtctcttattttcaaaaatgctatgatttttgtgttatttccctttctaaaatgtttcacctttgctgccacctattaatatcatatttaaatggccactggatttggcattattgcagtcattattgaccttaacaagagattttggttaaatggtgtagaggaaagcctaaagagaaggggaaaagagaaatgaagacagtgaagagcgataactcaagaaattttattgtgaagggaggtatgtaatggtgtggtgggggaggaggtcaaggaaagttttagttaagatggatgatattgctgaaagagtactagtgagagcattccagcagagaggggatctgtgtgatggaggacacagtggataattgcaggagtggaagggatccagagtgtaagccaaggggttgactgagataggagtgcagacatttcactcattgcaacagcaggaggggtggatgggatagcttcataaatgtgctggtagcaggaggctgagtttctcttctgatgcttccattttctcaatgaaatgagaagcaaaggtatcagcagggagtgaggaaaaggggagaatgttagagatttgaagggagaggaggtagtacgagacggtgaaagtaaattaactagaaaagtggaatagggttgctaggcagcactgagaccccattggagggtgtagtcatgaatttggagaacactcagcatgatcgtaatttgtttgtttgtttcctagctcattcagctgcttgggtttggcagagatttagtattgaccaaggttagaagtcttatttgtccagtaaaacccatattgaaaggagcaggagcactgatggtaatataaaggagtggttttcaatgaagtatggagcctagtccagaaaggagggaagtgagcaaatgaaggggacaatatgtagtgagaatgtggcttggaaaacccactagaatgaggaatggttggagtcagactattctgagaaagagccagaagaaaggaatgatgtttgaaattgagatttagagtaatgcagggttactgataaagataggtctcaggtaaggtcataatgttggggaatgaggtcaagtggaggacaaaaccattggaggttaggaggttgagacactgagaggccatgttgtggccagggattaggaaggagaagaatcgcaacagaagagtctttttacttggtgggtgatatttgtggcttcctcttagttattgaatatttcctgtagtgtcagacatccagaagctagctaggttccaagtcgcgccctccctccccctcaccccccagtaagcagggacttccgacatagcatttcctggacactggctctctggctaatctttcatccggtactcagttcctattccatgaccacacatcccgtatagttcttctgctatcctcaagaggcccttattggcaggatcctttgaacacctctccgggtatctacttgaatccttagtgtcattggtccactagctctactgagcaggttcccagtaacttttcagctgtgctgtgttagtgagagggagagtttctacagctcagtgagcatttgtccagtcttcttacatttggtttctctgatgggctcctgcagcctccttcacctggcttgtatcttttctcagataaatcccttcttcccacaagctcccctcacctgctcttatttgtagtctgaggtatgagtaagggttgcagcactgactgatagtctctgtccctctctctctctgaataatgagcggatgtttgttacccagtgtccttattcctggcatcccagccaaaactaggaatttttctttaatatcttgctcgtttctatgctgttgcatattctttcttaaacagccaattaaatgggttcctacaactttgtagtcaaaatttaggactataatatggtctcttttctccagaatctcagtagtgtccaaagtactatgtattaaagaaaagaagagctgattagtattcagaattgggacaaaagtcctgcaaatagtttcctaaaatatacttaaagtcatctaaaccatgagtaaatgaatgtcctccttctcccgactgcccagtaacaatggatgttagatggtaggcacaaaggaaattcatattcaaatttcttcattgtgatatgagttttgattggtatatgttttcttagcttgatcttgtctgacttactttggtgatatttaggtcttatatgtgtttttcctaagttatattttatttctctagattcttactcttcacccaaatatattataaattgtatcatctactttaacattatctttcggcatgttcctctggttctcaaactccactagccttttggtgacttagatgcgctggtctccttttccaatccaaagtccccacagactctgccttctaccagaaatgctccccacccttatttccgcccctgcttcccacccctcacacatgtaacttactcctttccatccttcattctttgtgtctaaacctaaatataacacttcctcagcttaactcccttaacaatccccatttccactgctatgccaagcagtatgtgctcttataacaccttgtgtttctttcttcaaagcattttgtcatacttgaaaataggaataagtatttgaagctttctaagacattcactaaaagctccatgagggcagagcagtggctatttttctaatgcttagcatggtgtcttgaacatagttggcactcagtaaatatttgttgaacaaatgaatgaaaattcctaataaatctacctacagtgaaatcaaaggactttgttagtgtgttcagggccatttgaggttgcgtggactgcaggaaagtctataagcctaaagaggctgaggtgtccatctaagtctgagtacttaagtattcacattttaaaacatgtattttgtaattatgtgtgagtgggaggtaagcatgaatttgacaaagaaaaatctgcattcatgtttatggtggtagtattataagtgtgctgctagttacaataattggcatgttgcttacataggcactgacttagcagaaaacttagcaactcttgaaaacacagttcaaggtctgcagatgatttggtccacagggccactgtgaaataaaacaaatgaccagtgtgagacaaaataatcttgagactttttccccatttattgagctttcatgttatgatattttgctattgtttaagttaggcatattgtcagttatcttttaaaatcattaagcagttaattcattgacttctgaaaactaagttcaatctaatttataaaataaataaaatgtctaaataatgatttccaaattaaaaaataatttcctgattcttttctaatatttaatttccatttgagtctgttcataaaacatcttattgttaattttttttaaatcatacacctctttaaagttcagaatatcaaaataaatatttctagttcttacaaatatatataagaagatgctttttcatttgactgtcgtttctctgtataggtacaagaaaattagacaaagactattagcatttgtgttctggctttcatagcgtttaacattcgttgaaaaatgatattgacaacattttttatcaccccctttatcttttgagaaaagtattattcccaggttcaactttcaaaacatgtccttttgaaagtttcagggtttccatggatagtttatttacctttttctacaccatgttctaactgcattaaagagtgatccattaaaaagaaaaaacaatccaacacttaaagaccttattcactgcctactggacccatacaatatggaataatgggactactttagatttagtattactgaggaaacttgttgcctacaagttcattctgaaatttatgttcaatgattagaaatcacagtgtatgagttattagaaatcaaagtgtaatttgcttctctgttaccatgaagaactactgaattttgaacccctgaacactctcttctagctgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaaga

SEQ ID NO: 1004 - DNA, 294437 bp, Homo sapiens
actgtgtaactatttattgctgtgtaacaaatttctccataaacatttattatctcacagttttggtggatcaggcattcagaagcagctcacgtgggtggctggtggctcagggtctctcatgaggtttcagttaagatgttgaccaagactgaggttacacgaaggcttgactggggctggagaattggcttttgacaggaggcttcatttcctcatcccatacacttctctgtagggctgcaagtcttcatgacatggcagtctcttcccccagaataagtgatgcaaagagaaggccacgctgccttctatgacccagtcccagaagtcacacactgtcacatctgctatattctattcattaaaagcagatcattgggtccaacctatacaaaaagggtggggaaattaagctccactcttgaaaagaggaaaatcataggcgacccatattagaacaagacagaattctgcacagactttcatcaacaataactaaccaacagagggcatttggcagaggaagcaaaccttctgtggaataacgaaacctacggtacagagagtgaactctcagccacctcccaggaggacatgaaacatcctctgcagagaacaattagagtgcagcacatttcacaacattgctgaacactgctccaacaggggcatgctcctggtggaagcaaaactggggctcagcttccatcctaggcctctggacccgtgatgggaagggttctttttccatattatttaaaaaataactaaagtcaaagggacattgtatatacagaacagtgtttgaaatgaacatgtataaccaataaagaaaacactaccacaaagagaattagaacattgccaggctcttaaaagatctgattctcccttcttaaccccatccctcttcttcccgttgagaggtaatcactatcttggctttggaataatcattcccttgcttttcctcgtttttttgtttgtttgttttgcttttttcactaccattgcatgacccctaaataatatattatctttctctgctttcaaaatgtaaataaatggaaccatatcatatatgttgtcctgctacatgcccctttggtgcgacagtgagtttgttagtttcattaattgctgtataaactccattatgtggatatacctgcattggctaatccaatctaatgttgatggattcttggttgatgaatgctcatgaaaaaatttcttttttctatatgcatgacccaatcacctcccaccaggccccaactccaacactggggattacaactgaacatgagatttgagcagggacatagatccaaactgtatcagacttttttttattaactttaattttgagttcaggggtacaagtgcaggtttattacatagataaacttgtgtcatgggtgtttgttgtccagactatttcatcactcaggtattaagcctagtacccataagttatttttccagatcttctccctcctcccaccctccccgctctgaaaggccccagtgtgtgttgttcccctctatgcgtccatgtattctcatcatttagctcccacttataagtgagaacatacggtatttggttttctgttcctgtgtgagtctgtgaaggataatgacctccagctccatccatgtccctgcaaaggacatgatctcattctttttatggttacatagaatttcttggtgtacatgtaccatattttctttatccagtctatcattgatgggcatttaggctgatttcatgcctttgctattgtgaatagtgctgcagagaacactgaggtgaacatgtctttataatagaatgttttatactcctttgtgtatatacccagtaatgggattgctaaatcgaatggtatttctgtctttaggtctttgaggaatcaccaccctgtcttccacaatggctgaactaattcacactcccaccaacagtgtataagcattcctttttattcacaaccttgccagcatctgttattttttgactttttaataatagccattctgactggtgttagatggtatcttattgtggttttgatttgcatttctctaatgatcagtcatgttgagctgttttttcaaataattgttggccacatgtatgttttcttctgaaaagtgtctgttcatgacctttgctcactttttacaagggttgtttcttttctttgtaaagaaattaataaatttaagttccttatagatgctggatattagacctttgttagatgtatagtttgcaaaatttttctcccattctgtagattgtctgtttactctgttgatagtttattttgctgtgcagaagcttgttaattagatcctatttgtcaatttttgcttttgttcagttgcttttggcatcttcatcatgaaacctttgcctgtgcctatgtcctgaatgatattgcctaggttgtcttccatgatttttatagttttgggttttacatttaagtctttaatccatcttgctttaatttttgtatatggtgtaaagagggggtctagtttcaatattctgcatatgacttaccacttatcctagcaccatttattgaacagggaatcctttccccattgcttgtttttgtcacttttgtccaagatcagatggttgtaagtgtgcagtcttatttctgggttctctattctgttccattggtctatgtgtctgttttttgtaccagtaccatgctgttttggttactgtagccctgtattatagtttaaagttgggtagtgtgatgccttcagctttgttctttttgcttaggactgtcttggctattcgggctttttcatatcagactttttaatgtttgacaatatggtgggtgcaaaatagatattattttgattttaatttatatacccttagttaccatgagcttgagcattgtttataattaattgttcatcatgtttccactcttgaaaagtgatctattcaattcttttgcatatttcccaccgtttttacttgttgatttacaatagttaaacattttggttactagtgttttgcaggtgatatgagttacaaaactttctcccagcaggtagtttatcttttcactctctttaatgatatattttaatttaaacacccttaatgttaatatagtaatatctatcaatatttcttttacaggttgtagtttttatgtcttgttttataaaaccgttttgcacctcaaggtcatattctcctgtaataccttctaaaatgctttataagtttaaattttacatttaaatccttaatcatatatgtgtgactgatttttacatgtggtattatgtaggggtccaattaattttccccattataaagatttctagttgtttggcctcatttattgaaaaatccactctttctgagttgatgtttagtactatttctgattatatcaagtatgcatatctgttagattagtttatggactttcctattccattgttgtgtctcttttgagccatccatactgttattcttaattacaataactttataataagatttagttcctaggggaacaaaaaacacaacacatgtgctgtgctttcaagcatagctgggcctgtgcaatctggccctctgtgtaattttaaaaacagcttgtaaaaaaaaaaatgtactgccggattttttttttcagaggaattgcagtgggtttctagattatcttgcaaacaatagacatctttataatatggaattattaaatccatgtacatgatccatcacttcatttgcttacgttgtctttaatgtttttaaatgaaggtttattgttttcccataaagctcttgcatatctttatagaattattcttaggtattacatttttatgctattgaaaatgatatatttttaaatttaaccttctcaatgtatatgttagtatgtaaaaatgcaattgaattttgattccaacaattttgctaaaactcttaaataaaattcaaaaattaacctaatgattaattagaattttatacatgcacagccatattttctatgaataataatagatttgtttcattccaatacttaccatttttatttcttttttccttaccatagtattctggtgagcctccaaacctatgttgaatagtaagcatctttttcttgttcttgacagcaaagaaaatgcttttaattatatagctttatgtgaaatatttgctatacattttctatagacactattatcaagttaaagaagtcatattcttttcttagtttgctagtagttaataagatatagatgcttaattttactttctatatgtattcagataatcatacttttttcctataatgttttcatgtgggggatacattaattgatttcccgatattaacccaactttgcactattttgatcaacccaccttgatcatgatataatttctttcttatacatggctgaattctccttatgaatatttggttaaaatttttgcatcttgcattcataagaataattggcctttttttgtactgttattgtttttggcatcaaagttatgttagcctacaaattttaaaaattttattggggagtattattcttttttatattctccaccatattttgggaaattttggaccttaaatatttgattgacctaactgatgaagccatctgactttagctttctttgtgggaaaagctatgactatgaattcagtttctttaatggctgtaagatcattcaggttttctgtttcttcttgtgtcagttttgctaggtttgttttctacacaaatttattcatttaatatacttttcaaacaaataggcataaagtagttcacaacatcttctaatcatttgaaagtctttagcaaccatagacttatccccatttttattcttaatattatctgtcttttcttttttaaagtactctcactaaagacaagatttgtccattttattaatcttttaaaaaactccaatttttatctttgttgattctctgtattttcagttgttcaatttgttaatttctgttatctttataatatcccacttcctaattgtttttatttgttttttgtttgttttgctgcctttttgccaactttttaaaatggatgcttagtttactaattatcatccttttttttctatttcaatataaatatttaggactataaatttctatttgctgttttagctgtataccacaaattttatatgtattttattatattaaatcatattgtctaaattacattgtaatttcttttttgaaacgttagtatatttcctaagtaaatttttctacttaacttttaattgacatctagcataattactttaggtctgagtaggtattatattattttagtcatttaaatgtgttgtgattttctttataaacctattcatggtaaatttgtaaaaatgattcatgtgtaagaatttgtattttttagttgttgggagcagtactctaaccccattaagtcaagtttgttaatcttccatttcttgttttttttttcacctgttttatcaatagctcacacaactatattaaaaagtaggtatgaatgtagtgcaagaaattattttcttcttgttataaaatcaaaatgaaattgactccaccaagaattggtgagaattttgaatattttaatgtcatcatcattgtgagttctgctctatccatagatcctggaagcaaaagtcttctggtcctcagtgcacactctttgctccaaaccctataggttgtggtttcagtgtcaagtaaaggtacagggatccctgatggggctagaatctgcataaccaaggcttcagctccctggcagagccacactctgaattcctgtaagtatccaggacttaaacattcataatggtctaggtccccattgcttgtgaatcctatagactctaatcttttcccattaatgggataacttctcccaacatctctctcgttttgctactcttcttattgtttccttttacattttgttttcaaaaatttccccaagaactttgagaagttcaatttaaactactctaccttgggcttgagggtggaggaatgagatgctgagacgtaagatctggtaataatgcctacaataggcatatttccctccacagaaaggtcagtacctctgtaaatatacaaaccaactgcctggcttcctgtttttttctgtatcacgttcttgtagtaccattgagaaagtagcactgggaggttgaaaatgtacctggctagcatccaagtcctgggtctgagttcaagctctgcttttcactagctacatgttttaagatgtatattaccatcttggagtctctacttctcatcttcaaatggggacaggaattctgcaagactctgaggtctacaaagtcagggcctgtgttctatttctttttgtattccttgggcctaattccacatctactattgtagatcaaatctttgttgtgaatgaaagaataaataaatttctgtcttcaagattttttgctatgatgaactgagacagcacatgagtaagctctttgtaaactatttttttttaagcacatgaaaaatgtatattgttattgtcacctttctattatatttcacagcaatgtgagatatcctcaaatatgcttttacatccctcatcctcaaatgtttagatcatcccccaatatttacatatttttcagcaattgtttaatataatctctacccaaggaagagatagaagccacttgaaaaaaagtcttagggacatctcccaaaactgcttattatttgaatggcttatattttaaaatgtgtgcagccaatttttcgctctcttgtgctccaacccttcttcataccacaggctgtgggcgtctgccccacagaccctgacccaatgacagatgaataatgtacactgacacacagatattctgctttgccagtccagctaagtgtctcagctgcttacagactccctggagagtactgtaaacagttgtcgaccagctagtgagacttacatttatttggtaaagattaattgacaaaggctcgagtcaacaccactacagggtaattgacaatgtggacttcccgagtagaaagcaattaagcacctgtggtaaatcaaaggttagtcttaagaccacatgagtaaacaagctagctagaaaaactctccacattcctttgttactactttaatatatttaactaaaggtaaagggaccaggccaccttcagccagatctattaccgaagttatgcaaactctcaggccttccaagagagtctgtggctgttactataaccatctttaatatttttcccaccagcctgattgaacccctacaacagactatggtaggtcagacccagaagtgccaagacttttcagacatggtccacaggtgtagcaagatgccccaagccccactcctcagtattttttggttcattaaatacaaaaaatgaacgttgtacttggccttatattgttttttaaaccacagactgcttgggttttgttttgttttgtttccatcactagtatgttttgctcctgaagattgttttctgaccccatgcctttgctcaagaaaagaaaaaattccctgcctggaatgcattctattcatcaaaacccttccctttctgaaatatcacctccttcaataagcctttcctgctcagcccactatatgagtatgagtatcctcatactcagaagcagctcacacatgctaagctgccctactccaattaagaagaaaatactaacacagcatctatagctttcattcaaggaaggctgagtacttgttaagatcattttttctaagttcacttagctgttaaagcagcaagggcaggatttggatcaggttctgtttggttccaaacccaccatgaggagccactgtgctgttttacctctgagaaagacctgacttaaaacccgacctctatgttatgagagtcaggctcctaggatggggaaccacgataggtgcatgcatgtcttgtcttgcattagagatttttatgtacattttccctttctagattataatctctccaagggcaagaactccctaacacctttctgtacctcttacatcattgtgacatcaaagattcttagcaaatgcttgttaagtaaatgagagcagacattcttgctccccactgattttatcttggatgctaataatacagtaaccttatttccaaaaaccattcccacagagcccgacacaccgtggaacaaaaactgagaattggattgaagaactggattgagaaaaggaaacactttggtgaaatcacaacctgtaaacagacctcaaaacatagtgttcactcaactgaagctgaacgttctatagcctgggttcatttggcttgattgcgcatcacttgtttacttggtgtgtataacactccacaggagtcacagggtccttttataggcatctctggtctgttgtgggccccgggtagtcatagtcccactgtcttgctcattatcctcctgcacccccaacacaactggacatcacacactaacttaacaattcagcctccttccaactgtcttaccccttctatctagtttcttcctgccttaattaacttcctagcatcatatgaataatcatttgtttgtttgctcatcctattgtggttgcccatcctatgatcttaacaagtactcagccttccttgaatgaaagctatagaccctctgttagtattttctttttaattggggtagggtggcttagtgaacatggacctgacagtgttggtttaaaatccagtgaccattgcatagttccactttaaaatgccctatgtcacattagtgtgaatgcacagaggcacagacaggcccagggtctcaggttagaaaatatgatgaggggaggggtttcttctaaagagaactgtggaattgtcggatgtgaatctgggcctgttgttcgtttctcgctatgcatgtttccatgggacggacactcagttgttactctcgctctctcccaccacttccgctctctttcacaggaagaggcgggtcctaccctgatggaaaccggttctggtctctgtccaatgggagtcgcttcctgtcctgcaccttcccaaccacatcagtgaaagggtggaagtgctggtctgcccactgcaggcttaacccatgttcttcctactaggaaagggacgtttccattttcatccacctgactcccgagttggttgcaaagatggaagaaaggaacagccatttattctcctggaggcaggccctgccggacttgagagggcctttcctctgaccctaagcatcagagcggatggagacagaaaatcctgaggccgctgtatggtgggtctcttcacagccatggggcccagccccactcgcctccaccaggttatggcccagcagctgggactccgtccagaagagcacctgcagcacgtatcctgtgttctccatcaaagcggcctggagtccgcctgcgtccccagcaagcagcactcccgccctaaaaccaaagggcgcagcaaggaaatgggagggctgcgctttgcttcctgtctgataactaccaacaaccgggcttctgcccagcatagctagataaggggagggcactccatttgacatgccctgaagactgtccaagcgatggcttaggaaggccattccaatttcaagtcctgaaagctgtaagatttttctgtgacttagagtgatttataacatagtttaacctctcaaagcttcacatctgtaaaatatggataaaactatctcaaagcggtattgtgcaagttaaatgaaaaagatagtgtatgcacattgtttggcactaagctattattattatcaaaagtagtagcaattagtattattgtttaaaggagaaaatgatatccattgggaggctcctctttggacctgaaagcttaatatctggaattacttagaactggaatgccagcctccgcctcctgccagcagcctgctgccaattctgatgagacagcttagaaaccattgccctgatgccatagaaaagaagaggacagctagccttttcctttctcttcacccttaatttaaaaaggttgggcaagttacacatccacccacctccaaacctttcaaacaagtttcagttatattcttgccgagtagaaaaaccaaaaattaataagagaacttacttaaaataaaaagttgttaacatcttgatacatcctggctttccagttaagagactttacagaatggttcgtgacttctacaccaaattctttcttgtatattttgtctacaccccaccccttccttagcctcaacctcatgagtgcaaatggagatcagccctggctcctggcatcccacgacgacttggaggtggaaattgttagtctggagtgggattgagggcccctgaggcagactgacactctttcagctgatgcatgtctaatgctgagcaggctgtgaccaaccaccctcaggacatgtttttatgcaagtgtgctgtagggggtggtcttcctcataagtgagaaaacatgaaagcaaagttcatttatcccatcagttggctgcttctcaccattcacctgggccctgcagtgctgagaaaataggatgtattttaatctccaagcagactggactccaatcaatttagagacacagagccacaacataattcaatttggggtgattccactgtctctgtaatgtctaaagccctaatgtactgctgactcttaggacaaactggcactgatcaagagtgaggccactaagccatcactgatttcagactctcacccctgactttctatgtatggacaacacttaatatttcacagaacccaagttgcactggaccgaagaagacctaaatagccatgtagtccatgtgctgccaaacacctggcaaatagttgcatggttgttaaataagcacacctcatatccaggaactcctggacaaaggctgaccattccatctggacctcctccaacttctaaaaagctttctcttgaatttggccaatgggcatccctgctgagcccacctttagtccagatgttacctttctggatgttcattcatgcatatagctgcaaacgttttccaacagcttgatattgctaggcactgtgctgggtcctgaatcaatgggtgataagggtaatcccactttcagcagagacactgacagcccctacttgacatggtcctgggttctctcattccccttgtctctccccactgaacctgcactaactgtcctatgtccctctttaagtgtaggcccagaattgatgttgcagtctaatgtataacaaataagtcctcgtttgtgacctgtttcagaaaatgcaacctaagattgggcagtcatgtcaccttcccgtttaattttctgtccatatgaggcaaaatagcttaagattaagaaaaagcttttggaattaactagccctggaacaagcatttgttgcacctcttacgctgcagagctgggcaaattgttcaatctgtcaagacatttttttaagtgtaccgtaggggcagttggaaggagtaatgaggcagtgtgtatacagcacctgacctagtcatggctcattaaaagctgctattctacatctcattgctgtcatctccaaaacgctgaagtcttttcacatgtgctgctgctccatcaaactcccagatgttttggggaggactggatggaggtcctaacaccttcaagatctaacccgtcacctcagcctgttctttggcatcctggatgtgtcacataacctattgtcatctcagccccatggcatttggagctgagatcaggatagcttctgtatcctcatctgagtaaagtatgaccaagtaagttcaagggccgcagcctggggtttaatcctgcgacctcccttctagacgagcatccattttttaattagtactgtttggctgtgcttattcaatgagtcatgagtcataaacttgtaacatctccagattgttttatgaagtcatatcaggatgaaattctgcctacctactatttctgtattatcttctttaggaaacatgccatgtggctacagaacatgaaaaaaccattttttttttccataaagtttctacatataacatgcttcctgcagaagtttgtaattcacatattctagcactaattataatcaggtaatattatgactttctccaacagaataatagtttaacatttttttgtgagaagataatgatgttttactcagtaaaatgagtttaaaattacaagttagaaaagtttatctagttgtttctatatagcattaatctgggctgctttgtcaaaaatttattttatttttgaatcagggtgtcactctgtcacccaggctagtggcgtgatcacagctcactgcagccttgaactcctgggactgcagttgtgcaccaccatgcccggctttttgtatttatttatttttttgtagagactgggtactctcatgttgcccaggctggtcccgggctcaagcgatccacccgcctctgtccttcaaagtgttgggattacaggtgtgagtcaacaagatttctttaaaccaaggttaaaagataaaaagaaggcacagaatttggtgtatttttgagtagtccaaagtaatttttattctctaattagtcacctcacgactttatttgaatgaattaatgagaagctaaataaactagctttttaaaaaatattttcttctctttctccaggcaatgggtcactttggggcgctgcagaacatctgtgctttccctgtgccccatcaccttcccagctcctgagctgtagccatctctgctgcacctgctgtcagagggcagctcctccggctcctgctcctgggttgcaggtgccacatctgtgcagaaggcttaggagaagcagtgagccttctaactgcagcagtcctgacaaagcactttgtgaacccctccgggacataagggcatcaaactaggaacaaaaacacagtcttgactgtgatttggtgattttaccacatacaaggcccgaaagccaattgaagacaagaaaagaagacaaatctcttgccagcaggagtaagattgtacaggagtctgagtatacatcagggcaagccaagagacagggacaaacagagagaaaaggttcatgcaattatgaatatgacctggagggggctttggaattagattacaacagtaacagagagttaatgccattttgaaacaatttaagaattatgtatttgaaggaactcagtattatcatgttatccaaaattatcccagttgctcataagacttgctaataacctggactgggggtggagggttgagggatctaatggaaaacatctgttaaaattgaatatgataatcatgtcttgtttttatgatcttgctcatgagacagtcttgaagagagaactgagtgattatccaagtaaatgtgtatttctatgaagaatgtaggtgtgtcttgactttgcattccaaaataaaaatgactgatcttttccattagcacagtttgggtcagcctaactgccagctttcatgattgtatttatttattttccctaaggagatacgggcactttgtgggccttcccaggctgctgcaaaatgatggatggttgggctccgtctaatccaaatgacacggggtgtcaggagcattggtaatcgtgtcctgccgacttcaaagcccactgccaaaacatccacagcacagaggtttggcaacttcacataatcatagcaaaaggactgcaacgtgaaaaaaacaggccctgaaacagctatgaaaagggccagttcagaaacctattcagctaagatgtttcggctagcgccttcgcacggtcaccttgtattttcaccttttgagttgccttcacctggaccaaggttggcagcatttgtgattcaaagaaaagatgcccagggaaactgactctagattatggaaataaacattgtcttcaagggatagccagcaacatcaggctcagggctagtgaatcccaagccacagtgcccaggtaactctgatgtagcaggactaaagctgtctacctagtgagagctcctgaaagagaaaccccgcagcaaatctagacgttatcccttgtttctgtaaagtgagaaattgcagctatccatgacgctttatttgccagtaataatacagtttgccttacgagtggtagcttgttcactgttcaacaaatgtattttaatcatagcaggaattaagggtgatttgtgaccaggtgctgaactagaatttctcaatgacaaccccagcttcataggcctctttccattccaggcataaatatggaggctccaatgtgaaacccggggtccttctgttccaaaaggggctagaaataaaagacaggaggggaggcaagaaggacctggagaggctgacgccatttgggtgccaaacatcctatttccttggctctcccttgcacaagttcctggacaaagtaaattataacacaaaatccacaacattcagcacatgttttcattaagcaactttagtcactaaaaaaagtgcaaatgcagactcctgtataaatctgatttgccatgctaggccaagcttattttattacatacattctgcattctaagaactaataacttcatattgtaaacattaagcatacagagttaaaattcaaggccacattatatcgattgtctcttttgtcgtgtgtctttggctggccgagatcaactcgtagtgtataaatgcataagttatataattattatataaaaagggggaaaaacattgacttgtatacttcattctgacaaacgcacagcgttcgcgactcaaaggaaaactggaggccgcctacccaaaatgcctgcgtgatttctgattgtggcagccaagaaggccatctcttacctgaccctgtggagaacaaagcccccacataatgatgaggtcctgaatgtttctcttaaatatcagacaattccagttaaaattttcatttgacaaacaaagaaagagatgcgcatttttgtttctgaattctactacttcccctttctccattacgctgtgtcctttctcctaacactgggtttggtataacactgactgcatgaaccctcgagtctccataactcattgtacacagtccccaaatgtcctgagtccagtcttcattgcttgagaagtttctttcccagccctggtctcctccttctctgcctcttcctcctccttcttcacccctctgtctacaatcacacgctcactctatacacatcctcagtcccaccttttagttcatagtcccggtaatactgtaaaggagttggaaactttgggtcatcttcacagtttgagaaagctgacagctgtccatcaaacggaatgtatttgatttcaaccaaaacagcacatgccatgcagttgcatatcaacgtctgttgatgggccacagtctctctcgtgtcttttctcttgtttttgatatgtttctatttttaaatacaggtagttttccttaaaatggcattataaacggtatgttaggtcaaaactgtgttgtttctattgctttagtttcatcccagtttgcattagtgggattccaaactctactctaaagtttatacatttcttaagaccactttctttggcactttgtccttaagacttcatgcttctacatacactgtcttttacaaggtcagtccacagatgatatgtccatattcgtgacatttttagcatcctcctcatttctgtagtaagacttcagtaactccctcccaagagtctttggatctcttccccggcttccttccccagccccagtaaagcttttttcattcctcttgaggcacttttgattcatgttctccgatagagtttgtggcgatgggctggtgaatgcacgctgatgggaaaagcctccgccaggtctttagtagtaagtgcccagatgagaaggcatatggctggtggggagcctagtgttggggtatatacccccagttggtgaattccagtatgggtttggggcagcaaaaaaactggaagatgtcacggggagggctggagggtggggcgccacaaagttcatcttctgtgggtgggcgtgataggagcccatgtacgggaggtctgaggggtacttgtacagagatgactccggggggtggggctggagggcctgggcgatcccgtggaagtcgaacttgtaggcgtagcgcttcccatggaccttggtcatgatgttcttgtcatagtagtaacggagggcgcggctgagcttatcgtagttcatgttgggtttgctcttccgctctccccagcgccgggccacctcgtcgggatccgtcatcttgaactccccgttggtgccttcccaggtgatgcagctggagttggagctgtccgacaggagctccaggaggaactgccaaagctggatctggccactgcctaatgaggtcaggagaggaaggaaaactccagtgagcacaggttccaggggaaagaggctctctgtgatgacggaaggaggtgctattggtgtgccgcccacattcccttcaccaggcctgtccgtccatccctcagctgcaggggtgcggactgctctcgttccatggccacccacttctccagagaactgcccttgcctgaacagagccgccgcctcgcccacccccaggtatcccacagctgggtggactgaacggggtaccacgggccggcccccttgcctcaaggaaagaccaactccatgacgctattcaggcttcagggctcccgtgggattgggctgaaacagcgtccagctgcaaggaggcttggaggaggccagaaacttccttagcgctgcccctgcagcacttcccattctctctctcctgagaacatgccgttaatcagtcacctgcacaagcaggcttaccccaagctctgcatcaagggaacccgacctaggacgatgatctaacagattcaagacctagatggaatgcagcgaattcatatggggcaaagttcaggctgcttccatccatttctgacgtccttaaaagaacagccagatcaacctggtgtttaggggatgaaagagctatatatttttttttcctattttgtgaagcacaaagtactgttatgtggatggcaataatgacttaatgccatttatattggctaggtcaagtaagataataaaagttagatttaggaaatgaacttctaaaagtttatggaaaaaaatcgagaatggaagtaaacaccattatttctaacataacattttgctggcgctcagaaagcaattctgtgaaaacttttcctagaacagaattaacccactcaaaatgaggaagtttaggaaaaaaaaaaaaaaagctggctctttttcaaaccagatcacccagttccagtatttgggcaagcgcatcgtaacggaaaccagtgccttgcctgtgtgctgcaacgccaattgtgttaagcagcatttccagaagaaaaaccccaacaatgagtgattgcaagtccccttgggaagctgaatgagactcttcctttgtcaaagagatcacatttagctgggtggacaaagtcagaattttcttgatttcattgaaatcatacagatacagctttgttttatgaaattcaaagaaaaatctaggcacatcattctagctgctatgttacaatacttgaagatagtttatggctccctagaagacagcagcatgtaaatattgacagcagtatccgtaccaagagaagctaagctgtgctgaacatatttcagaagcttaagaacagatgggaggtgggtctttcctcccaaattccagttacagcactgccttagacttattaccaaaagattaccttttattatagtgtaagtaatatcaatcgatgtgataaaatgattaaagtaactttaactgacatctactcagggaagtaatatactgtaaaaatcaattttacgttcattttcttctaaatcctcgctagcctcctgtacatatcacccaacttataaactctgctttgcatgttggctacatggacatggatatttttgtgaatttatccatacaatagcactgtgagaaaggtcagctttttctgaatctatgctggaaagtgctcattttcagtctagcaacacatttgaaatgtattaacagcttgtagctcattgaagtggaagcctttgctttttcagaaccacatatacaaactgttcccaatcaagttttgttgcctccaacattttattaatatgcatttagaaaatacaaagaatggtatgagaaaaccatatggtcttagtatatatattgtaaccaaaaaattacaacttgaaaaaattccgtatatgacctgggaataggaaaaggcatggatttttgatttaacagtctaacagatgcttcaatataaacacatacggttgtttgaaaataaatattcagcgtcaactttctcccatagagaaagcaactccacagacctgccgaaatcacacttggaatctactcaaaccttggcattgcctcttagcaatttgtccctcacccatttctcttataaacgtgtgtaggacagaatcagtggacaaaagtgatctcatgtctctcctatttctgaagagttagaaagcaggggacctaaatttgtggcagcaaactctatgcccaaaggatggatgagctaatttctcacttgactattttacccagtagccataaagacatagggctcaggactgtgagaatttcaagggagggtctatagaaataagagaactgtaagcaaaattcatcagctttcaaaccttgaaagaaacctggaaatgcaaaatcaatgaatgtttaagtaaatggtagaaagagtaacatcatgtcaaactcattaattgttaaatttaatatttgtaacaaaattcgctgcattttgcagtgtgtagaacaaaatttctcactgcaagaattctcaaaaatgaacaatggttgttaaaaaattgtcagtggtaaaggaattattctcagtcataaaattttaagagcaatttttaaattcttattttacttccaaaacaataacatttaatgtgtgacgaggtgcattttagaatatagaatagagatttccaaacaagaatgcttagggtttaggaaagcctaaaagtggcttgggtcactcatgggccaaaccaggatttacaaagagaagttcttgaaagacaagagctttcattgagtagcatcaccacctctaccttaggactcacctttcttgggtaaacccttcagatctattttttttttttactctctcttaataacatccttgcgatgtcagtaaggaggaactaattttttcttagggtaattaccaaaataaaacatatttggaggtaaaaaacagtggcaagcagcattgtccacctacagagaaccctgtgggtgaaagggagcggctgtggcttttaagaagacagaggcactcctttaattttacagaggaaagtaatctcctaatattgttaaaagaaagggagagaaacagggtagcaaaggggtacagactgagcaaaaaagggggaaaaaaaaactaaacggtttacaaaccacagagcaaagcagagagctgcagagtgagtcagcagctgtgtctggtggaaacagcatcctggtgcaaagccctgcagccgtcagctgatgaacaagggcagtaaatacagccgtgaggggccccaccagtaccatgtggcagtggtttggggccactttctctagaagccaggggtggtgcagaagatcccgtgtgcatggcctggaccctctgcaaggcagcaggtgtgtccagcaggtgtgtcctgaatggaagtctctgccccgaggctcagtgaggctcaggcaccacttactggaggggcaggaaagcatggtggtagggagcaccaactttggagttgccactgcttcagctgaatcctgcctctgccctttgtgggacgtttggcaactctcgcagctctctctgcctcagtatcgtcatctgtaaagtgggggtgatggtaatagtactatcttgcaagatcatggtaaggatgaactcagtacttgaatggtcttgtcagaatttctttgggctgaaaatcagagtttaaggaaagataacactcctctcctatagccaggaaatgcctaaagaaagagaaatactgttcaattggcctattgaaccatgaagaagcttgaaacggtgctattcttgggctgactgatatcctctgaaagcttactgtgtgccatgcaccattctaaacgctttacatgtattggtttatttaatccccacaggaatcatgtgattagtccattggagaagtgacgaaattggagcttagagaggtagactgacttattttgcttagcgttggcaagggttgaaatccagactctaggctgccatgcttaatcactgcgcaaacttgctttcaggcctggtttatgcacacctctgtagcctcctcaggtcctttccatgttgtcccctccctgggggactcccactggaagactgcacactgccacctcctaacaaatgggaaaacatccctagcctggtctgtcgttctgcaagaggcaggatgtattttcatgtgcaccattgaagagtatccagttagcatcaaggaagcctctgaacataacccaccaaagctctttcattagaggaaccatgttagatagattctcagctgctctgatgggatgtaaaggagctgtgttgcttataaccgatccatgatatcagaatgcagggacacactgttctcagcaggaaaagtgatgtccaaagtacacatcaagtgaatatttgggatagagatgttgggatgctgacatcatcctgtgcattcatactatatgatgcaatctttccacttaaaatgatgaaaaggaatttgtattgtatgaagagcaaagacagcaatttttaagtgatgaaagatttatttatcagagaatagaaaaatagaatcaaacaggaagaagcattgtcattaatacaaagataaaagacattctggtttcaggggaaaagttcacatgagcacaacagacacaaacctaaagatagatggagagaaagtcaaattcatcagaaactaaatgaaataaatctttatcttaaagtcacttgcctgcaaatcaaagatgggatgttgccattttctccaggcccattaagaacagtcttaatggtatgaagcacagtcctccttccccaggcctgtgatgagtttccggtctccttgctctgagctcaggtccctctatctacaaagggcatccccgggctgctgggcccagggcatatgcagtgttcccttgtgaaagctggcactttgcttaggagcaagtgactcaggccctattctacaaacaagccaagcagtacctttgggctgtgacaacgtggtcatggacatatatgtttcatttggccaatgtgtgagtgcaaaggccagtttggtcttctttggtgcagcttgactctttcctcctcttccttcctgacctcagattcatcgcctgcacctaagcagttatgaccctgaaaggaaatccttgctttctattctcacagtccgcattttgtaagacctcctcttcccttcatacttagtcagtggcagagtagggcaagaaaacaaaagtagactttgcagacagagtcaggtttctaacctgacctcccttatcattggctgtgtgacacaggaaaagttacttaacttctctggacttctaattccttttctgtaggatggagatagtaacctcccagggctgttatgagacacagaagggaccacagacattctatggggggcattctgcgggatgggagctgtttgattgttatttcacatgattgtattaacattcccagagtgtttcagcttccgtcattttcttttttctaatctatcctgaacattgctgccagatcagtcttcctgaagcatgactgataataatcatctcaaaacatagtcattatttttatttgaatggttatatggcagagttgcaaatgaaaagctgagcagaaggctgagaagagaccacagcctcaggagcctgggctactagatgaaagccagcatgagcaaaaagggcctgtggctctgtgtttgggacaatgttgtaactacctgtgtccatctctccacggaccaaaagcaccctgagctaaaggactatatctcattatccttggcattcatgtatgcaacaaataattattgagcacctagtctaggccccaggctaactagttttctttagattttcagctgtgtaaaaaaaattcattgaattcattaacattaaccaaaatttaacttcaaaaatacagatgttcaataatgataacatttcgtgttttcaatgtgtagattctcttgcagggatgtacactgattaaatcttaattattccatttcgaaccttattttggcctcaacgtttaggaaatacacattccatcttgtgcttgcaatatgcctgtaacatcttggcatttgaatttgcagttgggaatatgcagcataggctatgaatttctgaagctggtgccagcacagctggttctgatctgaatacaaacaaataaaactatgtggttggcactgaaacactaggacaggtgacaaaccttggcaatgcactggttacaaatgggctaattaagaatctgcactttcttctagcatcgaagttcagaaacagaccatcgaagatgagcctgaatttgaagtcttgtggttgtatcaaggctctcttttaaaaaatactagttattttatctgcttgtataatgggttgaattgtgttccctcaattccctatgttgaaatcttaacccgcagtatctaagaatgtgaccttttttggagataagatcctaaatgaggtaatcaagttatagtaaggttatggggtaggtattccaacctgaccaatgtccttatgcaaaagaggcatttggacacagagactgacacacacagagagatgatgatgagaagagacacgaggagatgatggctatctgtaagccagggagagcccccaggacagatccctccctcacagccctgagaaggaacgaaacctgccaccatgacactctgatttcagacttccagcctccagaactgcgagacaataaactgttgttgtttaagccacctaatccgtggtactttgttacagcagccctagaaaactattacagcttggattaggttataatgttctttgctgaagctgaaatcttaatttataacccaacccatctttccattaaggcaaataattcagtgagacctaaaactaaaatctgttcagttgaaggaatttctcaccaataccaatttacttttcaaaataaccactgccaaaaagtaattttgtaagaagaaaatcatcagcagtttctcacctggatttgcaaggcggctacttgttggtccaagaatctgataaggatctacagcaaaaagaaacaaagtcaaatcctagacatagttgtaacatagtatgatgtgacttcagacataatgcctgacttaattgttttttcagatttcagagccgaaaatgtcctccaactccaaatcaactgcctccacctcctctatgagagaagatgtcacacggcatctcagatgtcttgctaggggactcctaattggtggcagggcttggattcaaccccaggatcctgacatatagctcaaggctcacaccaaccaatgatataaagagggcaaacatgtgccaagccccatcaatccagggccgtgcaggctgtgttgtttaggcatggaaagtaaaatctaaaaaattaatggatcacaaagaagcagcctgtgtgcacgtagaatttttttccctatttattgcatagttggggacgtgttttagcaccatctcaagtcacctcgcatgagtaggctgatgacttgggccctatcttatgtatggagctgtcgaaaagaggcaaacaatcatgttaatttccattaaaaagtgaagcattttagaaatgtgctgctgagcctgaatcttctcttatggttatccagacggcccctgaaacatacctaactgaggacgctggtcttcagttttgggcactgtggaaggagatggttgagcagctgaaaatccagaaatacaaaaggcaattagctataacagatttggtcactagtctttgatgttgttgcataatcattctatcagttaatttagttattaacataatagtctaactcagaagcatctcacggtaaggaaaaattttcctttctgatgaaatcaaatgtaaacactgtaacaaaaaaagaggacatttccaattatttaaaaaatggatacctcccactttttccaaaagtaaaaaaaaaaaagaatttggaatggcttaccaaacagattacaataaatcatagtctaagataaacacataaagggaaaccaccagtcaaataaagtaaagccagggatacttttaagcatggccaagattcaggaaaacaccgattatttaatgtgtactcaaacatcccatgaaacatgcatttgtgaaggttgacatacactacatcattcctttatttttgttatgaaagtcctgatgacccaaatggagaaagaatcactgcagtgaaagatcaattgtactcttgtcgtcaatggaacaaacccatcacatgttgcaaaatcacagattaaccacagaaattattatatactccatcaacagtcatccactgcctgtgacatgaaactcagggtcatgggagccaacactgtacctttcgactggggcgtggggtggccgtgaccggtccaggctgatctcctggggggctcatatggtaaatctgtaaagacaaataaattgactaaaagatcaatcatgtaatttttataagagatgctttggttttttatttgattttgtatttattagaataaactttgtgcaaaaaaatctggtaatccaaagaaatatcccactagatttgagttttatttacaaattaaaatttcatatattatagtggtctaaaattctcacccgtttgtctgaaaacttccattggcagattctcccagagctttccaactcttctaatttcctacaaccataagtcaagaccccaataaaagtttcttacaatctagttcatcctgcttccactgggactgatctacatctgtctctttattatcttcatgactcatccaaagcagagtctacaacttggatgaaccagcccatttttgtttgaggtctgttcctaaatcaatcaaatgacattcagcttctttttcttcttgcatctcctgggaagtgatcgctgccttatctttttatttgccagctgcctctcttagccaactcccattttccctttataatctcatcaatttatattaaatcagtcttatctgatctagtgattttcataggcaaatgtctcccatttctaatgttctaaataaatttagaatttctctaaaatgacctgcatgaaatgaattacaggactgaaatagtattgctcccacagcccattaatgatgaccttctgagcttaagcatatgccaaacatttctttgtatttataaagtcgtatcacttgtcctataaaccttcatttacttttcatatgcaaatttaataactatacttctgcatcctcagtgtgagttctattaatgattatcaaagctctatgtcatttcaagtttgtttcaaaaatatattacagaaaccttattataatactcttgctaagagtgcatagctaaggctatttctacatgcaatcttattacataactgtttcaaaattatgtcttcttggattgcttggtctcagttcaatgtcatgtgtcattctgggccaagtgaaggccatggccaaatatctcagcaggtactttgctgccagacaccaggagatgtgtacaaaatttcacttggagggtaggacaatgcaattgtttttaagcttctctttaaacaaatattttaattttgtttaaaaccagcaatttgatgggtcaatcttcaaagagcttgactgtgttgcagaagatgtgtctcttcctattttcatatcccaaagagaatagaaatgatgcgcaacgtgaaagtcaacacagaatctccttaatgtatttggtctgtttggctgcaagcatctttgctactagtgtggtctatgaaatcctacccttcagagctttggagaattagataatttttctttttaaactgatgttactcctctctctcagctggcatttttgcatttttggacgtaaatcttttcccacccagatcctcagattttcacatctcttgtgttggggttacacataggaattatatctgcagcccctaacaatttacaactgaacttcaacttaagtctctgggaacactctgcacatgggttctcagtcagttgcattttgtctaaaataaactggacagccagagtttcaatttgcaaattgtctcagaaagaaaaacctactcacaaggcaatcctagccacatctaacctaatttaggagcagaaaagcacattaactaaggccttctatttaccaaatgaaaaaaagcaagataatacagaaatacagaaatatgttctagatctctgtttctcaaagggtggtctgtggaccagcaacatcaacaatacctggtagcttgctagaaatgcagaatcttaccccagacctactgcatcaaaatcagcattttgtttattatctttttttttttttggaggtggagtctcgctctgtcccccaggctggagtgcagtggcgcgatctcggctcactgcaagctccacctcccaggttcacaccattctcctgcctcagcctcctgagtagctgggactacaggtgcctgccaccatgcctggctaatttttcgtatttttagtagagacagggtctcatgctgttagccaggatggtctcgctctcctgaccccgtgatccgcccgcctcagcctcctaaagtgctgggattacaggcgtgagccaccgcgcctggcctcagaatcagcattttaacaagatcctgggtgactctggtgcacactgaagtctgagaaagcctgctctagaccattgctcttttcaggaactctgttcctgcagatgatttcagaaatgctatctagagtgtgcaaagacaaactaaaaaatggttgaaagagttctagatggattgcttttacccatggcataagtatgctaatggaatgaatagacagcatcagtaggttagtcagatactaccttaaacataaaattgttgctcatgaaatgtgactgggaaaaaaaataaatgccgaactactattcccaaaatattttgaaactctttattcacaaaatccttcatatggtgtataaccatatcccatcctccctcgaaaataagtcgaaacttaacaccaaacagtctacttttcagccaagtatttgagacagttatatgaacaatgattcacatgttcataaacatattgccgcggaagataagtgggcttttgttttcttccatgacattctggtccaatgcttccttatcggctaccgatcacatgctgtgggcactaagtatccccctgtgggatatgacattgggaaacattcaactcaggctcactgagatgggggacagccaggggtgacttctttggcagctacaccatctcaaaaccttcgtagttctgctcttgactgcttgaaaaatcactcctctatgtatctttgctatgtgtcctttattgataatagagcatcagacttccaataagaatatattttacatttaattttcgctgatcatttcaacaccctctccatttctctttgactttgatcttcaaggcaatgaactcatatgcttggcagaagtgcccatgtaagggaaggctgctttctggcactggttctgttgttttatctgtaagagactgtgtttaaaaactgagctttatagaagtcattgcataggcagcttgggtgaacacagatgtacattacatcacaacagtataaaaaacagcatgaagctacaaatagggactcggctagtgctgaccactacacaccagcaactgtgtcgatttcctgggagctgggatcagcttctcattctgaatgagactcctcctccaccacacccttttgaagacatcactaaattaatacaacattctggctaccctttcctggagggctaagttcagccaagttttacattctcccttcatcaaactcactgaggaggaacgctctagctcttgccccacacaccccacaccgccaccccgctgcctacccgctttattttttaaagggcaagaatgtggatcgtggaagagctcatcctcattctgcaggatccacaccatatctgcaaagcaactctggaggttccctggctgggctggatgggaacagatgagatttgcctgctcttgaaattagatgctaatggggaacacaaattaggaagagcaagagctgctgctaagaaccaatctagaagtgtctgtgaaatgaaaaaaaaagtttgagtcaaccttaacataattaagttgctctctattttcctccagatcttcttaaaattctacatcaaagtttgagcatggagttttggaaacattttgcattcccttcttgcctaggtttgcatatccctgtggttatataagaactaagcggaagcaaagaatgcaattttagccatttgctaagatacaggctttacataacacctaactgagagatgctatgcagtagttgtattgtctcactatgcctagctgtgctgaaaagcactaggctgtgagctccaatggaggaataatttaagattccaagaaacccctgaagagcagcagcttcaaagtagaagcaaaggctgcatttgcaggcttaactctctaatctcttttgataacaccccagaggcatatcataatatatgggttgtcatggggatggaagaggaaaggatggggttgcagaacatcatccttgggatagaactgagcttttgcatgacctgctcctaagaggacaggcagggtggtgcactgtgtagttaataggggcttgcaagattctgtggatctgtttttgccactttttcccctgagacctcaaagggctatggctccaaaagaagtggattcagcaaaaaagaagggtgtttgtagaggaggtacagaaagggattctggtcgtagtaactgcaacaacgtgagaaacacgtgaaacatcataaaataaagtataataaaatatatatatatttaaaaaatcataaaaccacagaatgtaaaatgatatgcctatgggttgatactttatgagagtagagaagactgtctcaatgctaattcaacaaaggggttgtgaaagaaggtaaatcttgaatcaggaaaacgtgggaaaatactaggtacgggcatgcaaggaaaagggatgaggtttggacaaatggcaggtagtggtggtggcagggcatgttcacatgtggtcccctgtgaggtcagtgaacggcctcggccaattgtgcagggagactgaactgacacagcagcagcgagactgacctgacagggaagcagtcagggggctctggaataaatgatccacttgggaaggtgggccatgaacagaagaaaaggtagattgggggctgggcatggtggttcacgcctgtaatcccagcactttgggaggcagaggtgggcggatcacgaggtcaagagatcaagaccatcctgaccaatatggtgaaaccctatctctactaaaaatacaaaaattagctgggcatgatggcatgcgcctgtagccccagctactcgggaggctgaggcagaagaatcacttgaactcgggaggcagaggttgtggtgagccgagattgcaccactgcacttcagcctggcaacagagtgagactccatctcaaaaaaaaaaaaaaaaaaaaaagaagagaaaagaagataaaagaaaagaaaaggtaggttggggcagtaacccagggatgggtgactcacagtgggaagggaaggagggaagggtggtgaggaagtgctgggaaggtggatgcagcaggacaacacacatgtgtaggagtctctgcagaaagggtgcggaatgctgtctaatttaaccagtaaaccctgaacaccactgtctcctctatcagggactctataatgaaacggccaccatgcagagaagagacagattctggtctaagtagagttgttacctaggagcctggcttgcttcatggtcagcacaataacgctgaccagagttcggttccctcggatgtgggattagacaaagggtatggaaatgaagatcatggcacagcaaaccaagagtggaggagacagggatttgggtctgtatccccaaggaccttcaaagaaacagtcaacaatcacctttctgaaagtagtcaggtacccactgaccacagggatatcgtcagattcccagtgacctccctctggagctcgttcagctctgaaagttagtgatgcaaaagctcttccccctcagccatcacgacgttcattctccagttgcaggttcacagcttttatctccacaggagcagtcctttaaggttgatcgcttagcaatggatgacccgaggtgtataactagttcttatctccaagttcaagtccctgaatagggcctacagtaaatagtcctctggcttgttcagtctgctttaaattctttacaggtcagataccaatatttgtattggttctcataatcacagtagcagtggtcaaaacaggttatttcaggtacaaactgagtcgcgaaaacatacttgactagtagtggagctgtggaagtgtgctctctcccaggtcacgctcaaattatgggcccatggaagaccaccatcagagcggcatgggaggtgtctgagtttgccacccttgccttccctgggttgggcagagagggagtcccaaccaacatcctcacagtcaccctcttctccatccacctggatgggccataccttccaaatccaccatatcctaaaatgtgaaaacaaagcagctccaggacccactgtcttaaccaggtagcatcagtcagctggcttgtctgacagagagattgtgccaatgaatttggccagtgttgtgatcttttaacacagtttataatactagctcacaacccctggctttgcaactcagtcagaggcacctatgagatgtcttaacataaacaaacaaatacaaaattaaaaagtaaaaaaatttttaaaaccctagccaaatgttttggaaatagtttttatttttttagtttatatggaaatattttttaaatgctcacagaattacaaaatctctaaagcttgagtcaaacatgaatttctattttccactcgcaatacacgtggtggatgtctttaggaccaatcttgcagactctaggcactgggtcttgcccatgtttcaatggcctgtgaaatcttttacatgacagagatgacttactacctcttagtaccccttagctgctaagcctttccatcatgcttcccaggagcaagacagtaaactttttctctgacgttagagaagagaaaattgccagcctgaagtcactaggcagtaaccagggcagtgtcagtatttgaacagcctgagaagcttcctcattcattctctttagctccctgggcccccagtctttctcattagaaagaaagagtagttgccaagcctagatcttgaaccagttcgaactgagacttgtgtattccggatatgtgatagagtttaacatgaattctggaagcatgtatgaatatggagaaaccatcccaccaccctgaacacaatgtcatcagctgtgaggctggtacaatgatacctagcttatcgggctgatgtaagtcccagggagaggacaaatgctaaaggcaagctatacccttctgggaaatgccctctctccctgctcattattcgtctggcaaacatctaattcccctttgccatgtggccattcctctggaaagcatctttatgcctttcatgggggattgagttcctccccacccctgctcctacgccctgtattgctagaagtggttcctctaccataaaatctatcacattagggaaaacatttatgtgtacatatgtgtctctctggctctaggtcactctactgaaacatctagaactggaggcaaaacatttcggtttgttcaccatcataccatccgtggctggcacagaggaggcactcagcaaatgaacaaaccaagctgaatgaagaagtaaactttctgaagacaggaagcttactgaagcctggttcatctatatattcccagagtctaacaccacgcttggcactaatgggcacttgatagatgtttatttttgcatgaatggcatgtaaatttattacctaattaaatcatttggaggacaggcagtaagattcagatgtaaatactactggttgcatgcttctgctctgcaagactggcttcttgtgacatactgataatcggtcactgtgaatctggggagtgtccttgttttgtgctcttcccccgaggagggacagatccttctgttagttcaaaagtcggcctattcctaactgccaggcatccaggatgccttctttgcccatctgtctttctgaaaagctagttaaagggctaatctgctcttaattcctttagtgtggtctttgaatgaaatggtttgagtggatttagtctccaaatcaacagaggcagaataagactgtctgggactggcttcagctccgggatcagctctctttgtatcacgtgacttagggcacggatctcagcaggacatctgggatgtctctcaatgaagagatcacacaggggtgttttcgtacctggcctagttgtaattctttgcgtagcttcaggatatactgaagtatttgggaaaataaaagctgcaccccctgcagacaaaaggaaagacaaacatgtgaaggtcttttgttgtggttgtcgatctcaacatcagcgccaaatctacttttccctatgacaacaaagggaagagacctcctcaaacctgccttaacagagctccggagaaacagacaggtgcacctgtcagattctcaagatggaagtgaaacttggagccttggtgtactcctgtgccccgtttgctataaagcgttttgtgttttgattttataacttcttgatgaagccctatctgtgtccccctcaatcccacttcccactgggcaatctcgttttattaaaaaattatatggtacatgttttatttttcaacttgtataaaaacccataatatattttacagagcttttggaaagtagtatcaagcaattataagtatttagcctaagagtatatggattttattaataattaatccacatctctattcaaatgcattttccctctctctcttttgaccaaaactcatgctgttagctgagaaaattcccttttcatagttcagtccatttggaatttgttgtcttgttcattggtttcttccgtgtttaacaatagcaaaatttaatatatttggagcttttttgaaactttcactcaatggttaaagaactcataaataaatgtgaaattatcagaaaatgtgcatagctcaaaggtgtttcctaagaaggggaagtaacttcctctaagttatctgttatttctggccacaaggtcactaataggctgatgtgtgcaaccaaaattattgaaaaagtgtactaccaactcgaagcaggttttttaaaacttcagattaaaaagacaatgtgttgaatatagaagaccatgataaatgagcaatttcattgtaatactcaaaccgggactcactcacattttatattttaaaataaaatggtaaatattgggaaaattgcgtatttctatgtgagggctgatcgtgagttaactggctgacttgcaaggctttctggcacttcccgtctccctccctagcccgagtgattgtggagggtccctgcagctaacagagtggggtgagcagccggtggccatgcttccggaactctctccatcaggaaggagcagatggatgtgaaccaggaacacattcatccacagaaaacccagcctctgctgtgagcggggggcgagggaggaaggttagccaggatgaggcacggtgttaaaccctacttaggctcaggcaaaataaatacataactaagtcaaatgtagaggcaacggttagagatagaaaacaggcatttggttagtgactaatttcatattctccaaaattatagcagaggttccctctgaacaaaagctctcaaaatgttacagaaattccctcctgccttttgcaaacatacaaagtctgtaggaaaacaaatcaaatagcctaaaagtttattggaaaggaaaaagaaaattccaacttatcctagcaaatatttctttaagaataaaaatggaaaaaattaaaggaggttgctaagggcccttttatatcgaacatgcttttagtgtctacagagtcagcacagcgaatatattgggaccaacagaagaagactgtaatccggcaaatgtgagctaagttatggctaaaggcaaattctgcacgtctcctggttaaaaaggaaccctttgataatcaaagtggggtgcttgggaagcgctcagaaaaccaaagggcttcaccttcctttaggctgtggtacattcctaagtatccgaaagtattctgaatcatctacctgcgttctgtcttcctggcacgcgctgactggtttcccatgaaagcatgcaacctgtacgtaagaccctacgctcttgctgggaggcaggggcggggccagcattacctgtgtttctagcatgcattaaccgtggagagttttgtaaggctttatcaacatcatctgaagtcaaatgtggaagaggagctacaaaacaaaacaaaaagcgacatcaaaatgaaaaaaaaaagagagagagagaaagagaattacctttcttacaaaaaaaaaaaaaaaaaaagaaagaaaaagaaagaaagaaaaccgttcccccactcccacactaacatcatgggaagcttataactatttccagcaacctgctacttgttagcatgttaaaacctacatgggggcccgtctttaattcagggaagaagtggttgggatgccaggcaaagcaatggaggagaatttatccacctcactgtctgtcacactacttccttctcaccatgctggacgttgtagaaattaaagcatgcagcaaacattctggattcatgccaacatgccatccctttctgtcaggttaagccgaatcacatgatacaaagtgaaaacttcccttgttctgtgctcaggttagaatataaagtggggcttcatgtagctttagggagaataatccccctaattcctacgaaagagaagccttaatgattctatttcgattcggggtatcatggagacttaactaatgtgtgaccagttaacgcttcctttcccctttgacattccatcttcttggtcgcaggaccctggaggaggcagctgagtgttgaagtgaattttggcttctcctgagagcgctgactacttctcatcaggtgatgtggccagggtgttgctcccctaagtcatcacataccaagcatgtggctccctcggatccccagtgggaactgggcgagggcaggaggatgctgtcgacacacctggttgaaccctctgaagctcaggtcataagaaccatagccacagccatctatccttggaggaagggggagcttactctctctgaggtagtggagatgtgagagaaggatgtcggcgttgtagctgggggtgagcctctggaagtcgtccttggtcatcttgcacagttccttcccatcgatgttctggaataacaagatgttgacgtctggaaggccatattctttcaccgcccactccagccactgccgcacatggtctgtactccatagcgtaggatctgaaaggggtgggaacacattcagtcaattcctgaagccagggatcttcatcttggggtagatccccatccacgtgggatttctgaccagctgccttccacaagcacagcctccagccagcctccctggctacccaggagaacattttgggggaaagacaaaagctgcctcacatccatagatcattgtctttaaagtgaatagttctggaatcttgggattattcacatcacatgcccttgtttttgctcaatctaaagtttcctgtaggcataagattttaaaaattcttttttctcatttatgttcaattttatttatttattttaaaatgagtaagaataagaggaaacttcttttccttagaaaactactggtatatttatatatatttatatggaaataagagtaagccacacatatcaggaaggtgctaattacagatcacaacaacaacaaaaataataataacagtatttatgcaaaatactgaaaaatactgaccacagaatcggaaatgaaatatagatacaccaagactctagcccctcctatgagccagcgttcctcatagagagctgtcagttccagacttttcctgcagggtgtttggttttgcaattaaccagcacctgcaggagtggggttggtgagtggtttttgcattccacagctggccatggcgagcacaaacaccccacaggatgcaggccacgtcgtcacactccagtgctacctatgggacagggagagcagggcccgggggagaaggagcaggtgatctccaacagaaacgccagccgggatgtcctgtggtaaacaccctcagtggtagggtcttcagagtgtggtaaatggggcggctgctcccttgggccccgagccctgagagacacatgggcagggagttggagccctgagttctaatctcaccatttctccactttctggaccttgctgtgggcagctatttctcctttctgtgtctgtcccacctgtaaactaagagcactgatctcagttcccgggacaagcccttaggggtcaggcatgccaggatgttccagtcctcttgaatgaaagtcaggtgtgggagtcacattttagctaatactttcagatccttgtttgtttggtcccactaatattttaggctactcaagaatggagcatgtagtatgctgctgcaatacatttttaggtttgcagaggtaaaccgtaataatagtgagaaacagccagccagtcatacacccagagttctcttcctctccctccttccctcttccttccttcgcttctccctccctttcttcccttcagctacatagaagaaagaaattattgcaggtccagtagaatctacctttcccattccattctcctactgcaaacacctatcctgaagttagtagctagtggttagaagtaaccactatcctgaagttagtacgtgtatcactcctatacatattttaatatttttaccatttaaactacatatattgttttgtgtttttaaagttaacataaacgatatatgatttgctattggcactcaatgttataatttcaagatgtagccaaatgaattcacaaagatatactcaatcattaagcagctcttaggcctcccccatgtgaataatctcaatttatttagtgaatgtcccctgtccatctccatgcatacgcgtgaatgagtccgcattggtccagggcctggggtcctttctggaatcatctggggagactgaaaaactagtgatgcctggtctcccctgggagagtctgcttcaattaggctggagggcagttgggcatcacagttgataacagctcccccaggtgactctaatgagcagccaaggttcagatcatcttccctgggcctcactattccaagcgtggtcctccaaccgcggaagcatcagcatcacctgggagctaattagaaatgctgagtctcaggccccacccagacctgctgaaccagaatctacattttcacatgaaacctggggacacgctggccttggctgagtacctagatacgggatttctgagttacagggcacatccatcttcaacttgaccagctagcattggatgtctaccaatatttaaacacccacattctcacttaaaaatcagtgcacaggccaggcgcggtggctcacgcctgtaatcccagcactttgggaggccgaggcgggtggatcacgaggtcaggagatcgagaccatcctggctaacacagtgaaaccttgtctctactaaaaatacaaaaaaaaattagtcgggcatggtggcgggtgcctgtagtctcagctacttgggaggctgaggcaggaaaatggcatgaacccgggaggtggagcttgcagtgagccaagatcaggccactgcactccagcctgagcgacagagcgagactccatctcaaaaaaaaaaaaaaaaaaaaatcatcagtgcgcagaacctgaaaactaaagggaactctggttttgctacagagagaatatcaacaaaaactccaacggcagtgatgacagaaaagtgtacatatttatttgtcatccaaacacttggaaacatgttgttagtctgtgaaaactgaatgtagatatggaaggttaatgttatccagttcactgaagttcagatgactcttcgtcattggctgagaatttggctttcagagataaaatgtttcttttttcatgacatgtcagaattcctctttctacaaaaatggatcatactgaggtcttagggcaagttctctttacctttggttctgtgcagaggatagtttgttcagccctcacagagagaagaccccccatcctacccaagtcattccctgtaagttccatcctttgatgttagcgaaacccacctttttgttttgttttgctttgcttttaacaaaatgggaggactattttttttttaatgtaacaactgtacttcctagaaataagttcattctgggaacagactttcttctctaaatggtggaaccggatattctcaaaatgacacataaacatattgtctgaaagccactaggttcgtgttaaaatggtgaaaggagaagtttaatctctctattatcccttggtgtgccccttaattggtttcgctcatcaagacaagggttatcctggcccattcagttttcctttaagggaatcaggtgcaagaccccagagacaaagtcctcaacctgtattgtacttatctctacaagtctcactttgagttggtaaaaggctgttctggagttccggagttctgccaatatgagtataaattactacagcctttctgatgaacaacacaataatacaacaatacaacacaacaatacaatcaaacgtctttaaatatgtgcagattccctggcttaaaaattccatttctagaaatttatcctaaggaaataatagaggatgtgcgcaatgatttattgtcaaggatgttctttgtagtgttgtttataatagcaaaacattggaaacaccctaaatgtccagcaaaagagaagcagttttgtaatgcatttaggaatgttcctgtgatatttagagactaaaaattacactgttgaaatatatttattgatatgataaaatgttcaaagtagattgcattttaaagtttcaaaatattattatgatatcattgtattttgcaaagatatataaatatctgcacagaaagaaattcagagggagatacagcaaaacgtgaactgttgtcactgagggaaaggagatggggaattttagatttgtcattttcactaaactatattttctcatttttctataataaatatggaatacttgggttacaaattatttatacaaaatgtattctctatttttcaaagccaaaacatggtcttacaaaaggtatatatatatttaatgtatattatatgtatactatatatcacctatatataatatatgtgaaagtatttttataaaatactttaaatactttataaaaagtattttttaaaagtataaaaaataaaagtaaaaaaacaaaaagaaaagttaaaaaaatgaaactatgcaaagcattttataaaaagtataaaaaataaaactactaaaatactttataaaaatatttttataaaataataaaatatataatatatatagaatatatacttacatatatgctatatatactacctatatatagtatatatgtgaaagtatttttataaaattgctgtcaagagtataaaaagttaagtttcagtttcttttatattttgttaatatagactgcttcatctgaaaagagtaaaattacatgaagtcagaacactcccacatccttttagcatttgatctccacacctctgccctataaatttctaagcaaacaatggtgaaaacaaaacatggccactcggtagaagaaatgagggcattccttttctcctgagcactcgcaccactctcccagacccactccggaggtgttgcaatagaggacagtttgcaggggaaaaacccagattccccagcatgaagcacacagtcctttgttccatgggtgtcattcccaaccattccccctccaccctacatttcctgagccaatgcctccatgcctgtgccacatgccacccacagcgtgaaggactagcaccttcttgtgccctcacctacactcacgacctcctttgggcatctgtcctagatgttctcacagaggaaacacttaacaaatctctgggcagtgaagtgataacaagactgaagacctagtctctgctcacactgaactccacctccactactttggccaggcaatgatgctgcagctgtagatgatggtttttagagttcaggtcagtgcactgggtccaggctgtcaggttttggtcctaaccttttaactccatgaagagccccagtagtctctctagtctcctccacactccatggtatctcagcaaagctttatggcttctgtcacaccaggaatcaaagaaaggggctcatgagttcctatgagattcagcaggcctgtcttcctcctttcttgaccccaaccacacatgtgtaggaggaaggggaggggactacagcataagccccagccgaggcatcacctttgcctatgtttaggtgcgaccttctgccctaggtaggaacacctcttgtctccaggtagcagtgtgtttggaacctgtcatttaattttataactggacctcatttttctcttctgtaaaacaatgtggagaatttcaggacctgagaaatgactcgaataggataagaactaagatagatttaattcaagtaaaagtcattaagcattatgcatatggctatatgcaccagtactatggagattccaaagtgtccaagaccaagagaaacactaaggacccactgagagaggcagcttatgaccacaaccacaaagcagaactaagtctctgtgatcaggctgggcgtggtggctcatacctgtaatcccagcactttgggaggccaaggcgggtggatcacctgaggtgaagggtttgagaccagcctgaccaacatggagaaacctcatctctactaaaaatacaaaattagccgggtgtggtggcgcatgcctgtaatgccagctactcaggaggctgaggcaggagaattgcttgaatccaggaggcagaggttgcgataagccgagattgcgccattgcactccagaagcctgggcaacaagagcgaaactccgtctcataaaaaaaaaaaaaaaaaaaaaaagactccgtgatccaaggaggaagtggaagtgcagagaggtagcaccaaccaggaaaaatgggaaaggcttaccaggagagtgaacttggattaacagcgaggattttgacagaagtagagagaagctctttggtttaggggaaccacttagcccagcctcatccgacatgggcatgaaatatctgacatgtttaagaaaaagggagaaatttggtgtggctgcagtggaggatttcagagagagcacagcaacatacgaggatggggatgaaagctgggctcagatcaacaaggtccttgagtcttgctaacaaggttggattttcatttttagagatttcagagtaattgaaaatttctaagaaatttttaaaaatcttaaataacaccaatcacagaaaacttggtgatgaaaataaaaggctttattgggaatccaaatacccacattgggattcttattcaaccatttactggacgtaaacgtcaacctctctggaatttgttttatatttttctgtgggtaattaaatgaaatgttaggggaatagaaaagtaaatgagataatggatgtgaaagcactttgccaacaataacatactgcaaaaaaagaatgcatccacacactcgattttgcattgcaaactctgctaaaatggaataagaacaaaatctgttatcacaggggcagcctcctccttaagacacaaaagtccaatttataattttattttaagaaacttttggagatgcttctgtcagatgaatcataagccattgaagataagttgttcattttcagccttccattccaattgttttgaaaacatctgtgtcatcattctacatgtcatggacaccaaaatggtaaactgtcatggcacaggctaaacagaagccatcactctctgaagcctcttatttgtatcttaagttacatggttattatgaaatctactttggtaaattggaatttaaaaaacaaataaaagtaaaccattacacacagagttctggagttgtactgttaatgtactctgtatgtggagtgggagtgggggtataagcagtgggagggagggaggaaggctgacatttaaaaaaaatatttccatgaaacaggattctgacctagtagagttcccctgttgccaggaaaatattgagtagatatttaaatcaggcaaaggggcactgcatcgccaaagacaaactgtgcctttgtgaaacaaaatgcctcacacaggcaaacatcttctttcagaggcccctctagagaaatgaataaagtaagattaaataaaagccaaactggtgataatgaaagtcctgaatgttatttttcttaaataatatcaacgtaaaatattggcttcccaaaagaaaaaaattactcttggttatgaaaaaaacatcaaaaaataaaaactaaaatgtacctctaagccatatcacaagcctagtgaggtgtttgtttataaatccaggccctgggcaagtcagccaatctgctgtccaagacactcataagcctgcaaaaataagatttaacatcttgcatcctcaggaggacagaagttacatttataaagcaggcccaatagagagaactggcttaaatttgagcaatgattcactccatcacaaatggaaatttgatctcaaataaagagcctacctcaagactgtttctgagccttttaaatttctaacttatatgtagagttcatttattgttttggtattgatttctaattttattgcacgttggccagtgaatagagtctgtatgaaattaacattttattttattttatttttttgagatagtgtctcgctctgtcacctaggctggagagcagtggcatgatctgggctcactgcaacctctgcctcccaggttcaactgcctcagcctcccgaataggtgggattacaggcacccaccaccatcgtggctaatttttgtatttttaatagagatggggtttcaccatgttgtccaggctgatctggaactcctgaccttaggtgatccacccacctcggcctcccaaagtgctgggattgcaggcgtgagccaccatgcccagctgaaattagctttttaaaaagttccggtttgttactcttttggcggcctagtgcatggtcagtttttataaatgttccttgattgcttaagaaatgcatattctctaatttgggagtacagagttctagaaaaaaaactcttggtaaggtgtatttaattttaatgtcactgacctatcaattactgagaaatgcaaattaaaatatctcactaaattggacttgactatttctttttgcagttcattacatatttcaaggctatgttattaggtacatgtaagtttatcattattatatatttgtcatgaatttagccttttttcactatgtaatgaccctcaattatctccagttatgctttctgcctgaaagtatatttagtctgctttctatttctatttttgtcagctttttaaaaattcaattttcactagcgtatcttattctgtcaactctcaatctttgtttgtgcaagatttttttgtaaacaacccataactgattgtggagtattttttagtctagtctatcactctctgtctttaatggcaaatttggtctatctacacttattatcactgatctatctgatttttaccatcttattttgtgctttatgttaaactttcttagtccattctctatttctccttgccaagtgtctaatcagattgatctacttttcttcattcacttttttttctttgtttctgtattggttttgctctttgacattctagttctctttcctgttaatctttaaacaaaatctaagtttaattaccagtaatttagaaagcttatacttgaatcatccatctctgattttacatgacaatgttccctcatatttttactccactgaattttctactccctacttagggaggctgtggttgtcattttacagccatttctttctagatctaccctcaccttaatcaatttcattgctcccatttccttcctgtatctcactcccttcttctaggatccattttttaaattaaatcttttgttattatctgaagtgaggttcaattagcaacaaactctctttttaactccttcttttatgttcttccttaatatttaaaaagtttatttattttatactctttatccaatactttaattatttaaccttctgcttaatcatgttcattgtttctgttaaatcttggttgggggagatctctcttcagctatttttttgtaatttgcgggtggcagagtcatctttagcgggtctctatctgcaggaattctgtacagcgtaggttgaagacatgtctctccatgaagatttcgtatttacttctgccaggtttcccagattatcactagcccatgaccatttttctgtattaatttctcagccttagagttcctggcacacactgttgtgtgtatggggtggggactcgggtaatgacaggctcagttccaattctctgctttgtggaagctcaagatttcattccttgcccctagttgacctttaaaacccaaatctctgcattatagcaacctaggacaaccaggtgtcaacataagaatgtgctgctctgctctattctcacttttttccttattttagtccctaaggagttcattgcctttcttcccagttcagctgtgcatttaaaaggatgttaaactccatgcagcaattccaggtgttttgcaaaaggaatgtttctcaggtccttttatagtaacctctctattttactagaaccaagagccctctctgcatactttttacctatttactttgaatagttttcatttttaatgcagccatcatcctaactcatgttatgctttacttcattcatttattaattaatcaattgtcaaaaattacttatatgaattgtataatcctctatgaaagattcaaaaatggcaagaaagagtgcctgtcctctacttgtttgagaatctacaattctgtgtattttatttaaaaatacatgactaaattatttttgttaggctctaaacatagctttgtcattctgacacactgatttatttctctggatgaaaccattctcaagtaatcatcttgtttttggataatgatcgttattgttctttgttttcttttgttgttgttgcctcctgttattccatgacaacattgtgtgtgctcatcatgttttagaaatgcaatggcttgttccacataaaggtttctccctgcctgggttttctttctttgtcttctctttaaatgttgctatccccagagtttcatccttggtctacccctctcctctctccatatgtatctttgggcattcttatttgctctcatgtttgaactataacatgcatgctgtattattttcctagggctgccgtaaccaagtaccacaaaatgtgtggcttagaaacaacagaaattcatcgtctcatagttctggaggatcaaagtctgaaatcaaggtatcagcaaggccttgctccatccgagactgtggataaaatctgtccttggctcttctagcttctggtgctgtccagcaattgaatgttccattgcttgcagttgcatcagtccaacctctgcctgtcttcacatggagttctccctctgtgtttccatatcatcttccctctgtgtgtgtctatgtccaaatttctcctttgtgtaaggacaccagtcattttattaggctcaccctaatgacctcatcttaacttgattaaatctgcaaaacctctatttccacataaggtcacattctaaggaactgggggttaggacttcagcatatcttgtgagggaggcacaattttttaacctgtaacaggcagctgtttctgccagtctatatcttgagtccccagggcactctcacagatgccagacccaaatataaacagaagaactgcactttttatcccaggtactgtttaagcatgtcacacatattgctatatttaatccatatagcaccacatgaagtaggaattattatcatccatattttggtgatgaaaaacctgagaaacagcaagattaagtagcttcccagatcccacagttagtacatggcagagtttagaactcaagtgctgtgactcccgatcaaggactttccatcctgagctctaggcccaccacactgcctgacaggtgtcccagaagcatcttaaacacaggatgaaccaaactgaaatcacctattttaaacattttttttttgtatattcattaacacctacccagctgctcatgctaaatctaagctgtcttcaattccattcttctctttgactttcaagaaaaacagataacatcattagcactgtagaaatgtaaaaattagccctgggcaacacagtagattattttacaaaattccctctccacctcctttgtttacttaagtcttatttgaaaaggctgttgcagaatgtctacaacaatttaacaaacacattctctcatcccattcctgtgttctcccctgggtatttttgtcagcacagcttaggaagaagaacccagactgtggagtcagaaagaactgggttcgaatcctggctcttcaaatgattggctgtgacatatttggcaactctcttagcgttcctagttttagtttctttactgtcgagtgagaatgataatgagtacctacatcatagggtggtcgcatgatttaaatgagataatgccttttctacaaagtgcatgtccaagtgcctgacaacagtgcatatcaatagatagtagctgtcgttgctttttagaaaaatgacttgattttagcctcacatttaacccaatggtggtttcctcaaccgctattcagctgataactttaaaatacacataataaactttgatgttagcatttctattttagtgggttttgttatttagttgtttgagcatagcaggaatttaaacagaagattaaagaagcatgtcccatcatatcgacagagtggaagagatcctcgggtgtgttcagggacgtaacaaagaaagatgaagacacaagtcatttcaccagcaggttctgggcctgagaataggctctggtctcacccagttgtgcaagtgttcccgggaaagtcatttcacctctctcagtcttggttttctcatgtttaaaggaagactgaacttagaccaccaagaatcctgcaacccctgcgagtctgcgattcctgctagttagatctagattactgttaacttgataaatcacatttactctcctccacacagaatccaagtgctggctgtgttgtctggcgattgagaacacaaaagacatgatcatcacctcactaaacttacaatctaatagaacagacaggcttataaataactcacgctaagaggattggaaacataatatatcagccatcagggcttggtcggagggtatgttctattacttgttattcactggctttcaaagcccagtgggggaatgtcaatatttagggaggatcatgtggaaactatgcagtcctctaacactctgagaactcaagatcccttctttacatgaaatcagactgccaaagactcatgctgggtgtctgtcctctacctgtgctgagctattctctaatgtaactcagcgctcacagaagatgtcacaagaaataagctgttgaaatgcagtgctgcaactgtggcaggaagacggtcgatggtcaggtctatggccccagtggccccaaaagggatccttcttttaggattctacactatgataaacattgccttccctgtgaaacttcttttttgaaaggaaaaattatttccccaaataactcttttcattttggctgccaggaagctcaaagccatactagaaacttaagtacagcatcttgggcaagcttgtggtcaaaatggctgcattcttccctcacatgctcttggcttctcatttgtatttttaactgccttagcactgattcctaatttccatttgataagtcaattgggtataagcccatcagtagtttagttcacacggcacctcaaatcctttgcagaatatccacatttaagtaagtatatacatgcatttgagaatacaatatgaaacaaaataaagtatgataacaaaataattggtaagatgtcataagaggagtgattaatttgccagaggatcaagcatggctcccttgacagggcagattttgaagatgtctggaagaatgagcaagagcattccagagagggaaccgcagggacaaggacaccgggtggtgaaaatgcagcgcgtgagttggggatgtggcagaggaaaacggcagaggctgcaaagggctttcgaaatcacatcatcgtgggtataaatgaagctgttcttgattcgtcctgtcatagcaatctccattcctcacatgctctgaaatactggtctgagtcattcatttgagctctcaatcacaccttctcctgtctgtcaaaaactacttaccccacatgggtgggtcttagctacttctgacagccttcggtcatctcctcagtgattaagagtaatgggaactccatgaacactttctaacggaatagaaaggtcctagcacaggggtctgagtaagacacaagtcatgtagcttcagccacacatgtttggtgggcaagaaaaggtgattttaaatctcattagagcttttattcacggtgaatggaacacagtaagagtttaatgaatgaattaataatgaagaaagtgaagagatacagtgaagagaagaatgtggctactcttatctctgagattactgattattgcaagggtctatgctgaaagtgaattattttaaaaatagaagcagaggcatttgaaaaactcaacactttagcacctattttaaggaattaaaacagaaaaagaggccaggcccggtggctcacgcctgtaatcccagcactttgggtgaccgaggtgggtggatcatctgaggtcaggagtttgagaccagccttgccaacatggtgaaaccccgtctctactacaaatacaaaaattagctggctgtggtggcaggcgcctgagatcccagctactcaggaggctgaggcaggagaattgcttgaacccaggagacagaggttgcagtaagccgtgaccgcgccattgcactccagcctgggcaacagagcgaggctccatctcaaaataaataaataaataaaaaataataataaaaaaacagaaaaagagaaatctttcaaaatgctataagctgctaaagcgagaggtcctattgcattttggtcagcattttgcaacttttaagaagtgaatggagcctgtgccttcctctttgttagccacttggttagcacatctccatgttcacagccaacacctaaagagtaacagtaactactgcaatgagtgattcttcatttttttttggaatgttaatgtgatactgttaatcatttctatctttcctttttgtctacttgccttttctaaaagtgataaaccatatctttattaaaaataattcaagtctattaaagtaaaatttatatcttctatctagattagaacttttcaaccttattgtacatgaaaattacatacacaataagcatgttaataatgtaaaatttccaaccccacacccaggtttggaacatttggaagtgtgtgtgtgtgtgtgtgtgtgtgtgtgtgtctgggaaagggtctcactctggcttcctggtgggagtgaagtggtgcaatcatggttcactgcagcctcaaacttctgggctcaaagaatcctcccgcctcagtctcccaagtagctgggactacaggaaccaccactacacctggctaatgttaaaattttttgtagaaatggggtcccactatgttgtccaggctggtcttgaactccttggcctcccaaagtgctgggattacaggtgtaagccactgtgactggcaggaaatgtgtatttttaatcataaattttccaggtaatcttgatacaagtggttctgaccatactttgaaaaacactttctaggccaggcgtggtggttcatgcctgtaatcccagcactttgggaggccgaggtgggcggatcacctgaggtcaggagtttgagaccagcctggcaaacatggcgaaaccccatctctactaaaaatacaaaaattagcctggcgtggtggcgggcgcctgtaatcccagctactcaggaggctgaggcaggagaatcacttgaacctgggaggcagaggttgcagtgagctgagatcctgccattgcaattcagtctggggaacaagagcgagactttgtctcaaaaaaaaaaaaaaaaaaaaaaagaaagaaagaaaaagaaaaacactttctagtcaacctccaaattaagctcggccaaaaaagagccatgtaaccagcatgggggatgtcacacttgtcaggcccctcttattacaactggtttcactgaatgacacttgggtttacgacagtgtaagagactgccctgccctatgagagatcctcctagatttacagatactcgcaccaaatacatagataaaaaccagagatgggaattatggcctaaccagtaccctttgggaaggcacaatcaacagtcttgccagaacaacaggcacaaaccagggctgcccagaatgcctggtggcgctactggttgaatgctttgctcatgactccccttatcttccttaggacaaacagaggaacacatcttcctccagactcagaattaatagctggaccatcttttcacatttgctttctttttatcctgtaggcactgaattatccctttcatactgcctgatgatacctcgaagccaaataacacctaccttttgcaattctgcaatatttaaatgttgcaattaaaaatacacatacacacacacacacgtgcgtgtaaacctcactcctggttttactctctctgttcaatttttactttagtccattctccacattcctttatttttaaaaagtggattctaccgtgctctttcatatgtatctatgtgagctttcttaaatctgttctgaaataggaggcagtgtaaatatatcaagtgacagtctacatttatccttcagggacattttctagttgacactttcttatgggcttttttttgacactttttttatgggcttctttattaactcaagatcatgagtatcaaaaccagggttgagggaatcgcttctcaaaagtgggttccaggtaccagaacccaatctgaacacggacaaagccccccagctcctctgtggttttatctctcagtctccgtacagtacaaatttcctcatcagtgtttattagggccactgctatctctagtgtgtaaacatcggcatgtattgatgatggtacaaatgtttaggaataactgatggtttttttttttttcactcagctatccgtgtgatttgcattagtgccaagcaatgtctctaagtagtaaggtctatgtgaaccactcaggaccaggtctggagaattctttttgcacacatggggtactccgtgccccaaatctgccttagtgaggtgcctggataccatggggatggatacagcagctggtacagctgcctgaggtcctgcaacctcatggccacattggaaaattgtccagattgtgcaatgaagctgtgtgtgtgtgtgcgtgtgtgtgtgtgtgtgttcatctctgtgtgtgtatgagcacacatacatgaagcttgaccaataactgaaagactcacaacttgcaaaatcagccacaactagctctcttacaaacactattaactgaataactgcctacactggcgtgaagcaactgaaggagggaagagctgaagagaagagtactttgctccaaagaaaggaaacagccttcacatcaaagcttactataagccaatttgcagagctatccttgcatccatccagctaatatttgatgagcagctactatgtataaaaaatcctgggtgctctgacttcagttgattctctgttctcttccccacacaaatatctctcttattttctaaatactttccttagtgtagaaagactcaagtctggccctactgaaaaggatatttatgacatcaaagcatattgatggcctcatggaaatacagcctcaccagttagaagatggtaccaggcattacctcttacatctgtgattcaatgaggaaccaagcaaggaatcttcagtgcaggccccctcagatggattctctcatctttgagatctaaacactttgttttgtctcctttgaagaaattacattcttaaggaggagggcaaagggtgagatgggttagggggcttcctttgggtgtctacttcactttgttcatgcccagagagtgtctgggcaacacaccactgccctcctgcctctcctccaggcacatcctagccttcgagtttttcttatgtgccacacatctggagtgggcacctgggacatttgtgtttctatttttcccatccaacaggaacagccccctgttctgaggcacagcagcaagtgaggcagtctcaggcattcaggtgcattgtcaagatcaaaccaaatgcatggcctctgtacctgtcaactgcctttcagtaaatactaaggacggttttctccctttcgtaatctaccatcagtgtctcctgtaagtcttaaaaaatgctttgaaatcaggcacaaccccaaaggatggtccctttcacaccccactgcatcgaaccagctttacgtgtttgctgaaagtcacatggtgacagatctaagctgaaacctgggattcaaatccaggccagatgttttgcaaagtaccctgcactcctgaactcttctgtctagaaggtgacagaagcccactgggcatgatccaactcaggtaaagggaaagtcacaccatggagggaatctaacctgtttgccatcacacttcgcagatattaatttaggtgaccccaggagcaagggagaattgagtttgtgcagatttcacccatgcatgcccttggctactttgccaacaaggagtaacttgtacagtgcagctcagtggtgaggtgtccgttcatccattctccacctcccttaatattcactgagcacctcccacttaccaggcactgcaactggccctggagatagggcctttgtggggcttatgttccattcagggaagaggataataagaaaactttttatttttttatttttattattttgagacggagtcttgctcttgtcgcccaggctggagtgcaatggcacaattttggctcactgcaacctctgcctctctggttcaagcgattctcctgcctcagcctcccaaagtgctgggattacaggtgtgagccaccatggctggccagtaagaaaacttttacataaacatgcaatataatggcagaagggaatgaatgaaatcaagaaaaatcaggccaacaggagactggcagtcacaggtggagacgagagcaattccagacggaagtgctcaggactggcctccctgaggccatgacattggcacggatacttggtgaaggaaaatgatatggaactacctggaattaagggtttcaggctgagctgacgccaaattcaaatccctgaggcaggaccgcagggtgaccagatggctgaaacaagtaacaggagggaacccacagaaattgctgtaagcagctgagatttaatccaatgccaacaggcagagactaaaggagtaaggcagacctgcctgagtcctaacttggcctcttattagcctaatgcccttggaaaagttggtggacctctctgaacttcatcttcctcatcagggaaatcatgagaaagatgtccatttgcaaagattgcttgagatcacgtttctaaagcatttatccaaatgcctcctgtagggtaaaggttcactgactggtgactgttgctgttgttcttatatttctggctttaggtagcatgtatcctctgaggagctttaagtcattttttctattacctttagtttggctaaataaataagttcttgtcacgtctttcaagttcaagagctattcctttgggttggttttgaattatgtttgtggtaaagagttactctggttattagaatctgtattacaggccagtgatagctggaattttagatgcttaagggaacacgtaagacagccatataatatatggctcccacatgtttatttttccagataagagaattttaaaaacaaacaagtctatcatctatcataaatagtacctcatgaaggacaggatatttggaacaataatctccaagaagtggcaattcctccctagaaaggtcacctttcatagacatatacacacgtgtgcatatgtgtgtgcacacaagcaaggctgcatgtttgcctggacatcctctttctctctgtctctctccatacgtagtgtgtgtgtgtgtgtgtgtgtgtgtgtgtgtgtgtgtgtatttttctctatgtggcaaaataaagagctggggctacatactgctgtctcacatattttttaaatatttgtatttttaaatacaggtgtatttttcttgctttgctgtcgatccgtgaacatgtcctcatgcatagacctctgccagctcccatttacaagccctgctctggacaaaggagatgtgatcaatgccacaggtgggggagaagagctccctgaggctcagcctagccttggggaagttgcgatctgccgagggcagtgaagctgtgggcacctgacctgctggcacgataactctgcgctcgttcgtggtcatgtttgggggtggcatgtgcttctcctccatgtagctgccgtagttcatcccaacggtgtctgggctgcccaccatcttcccgcctttggccacactgcattcatcaggagagttcctggaggagaagaaatattcttccattataacagcaatcaaagagcatgtctccatcgacttctcacaatacacagagagaaccaaagaagggcaaggcggaagagactgggggagaaaggacaagtgtgaaaagccaaatacaggcggggtgccgtggctcatgcctgtagtcccaacactttgggatgccgaggtgggcggatcatgaggtcaagagatccagaccatcctggccaacatggtgaaaccccgtctctactaaaaatacaaaaattagctgggcatgcctgtagtcccagctactcaggaggctgaggcaggaaaattgcttgaatccgggaggtggaggttgcagtgagctgagatcatgccactgcactccagactggcgacagagtaagattccatctcaaaacaaaaaagaaaagaaaagaaaagaaatgccgaaaacaggccttgccttctgtcctcccgaaatgcatattttgaagccctaactcccaatgtgatgatattaggagagagagcctttgggaggtaatttcagtttgatgaggtcatgagggtagagtcccacgatgggattagtgcccttattagaaaagaaagagaccagagctcgagctctctctctctctctctctctctctctctctctctctgccatgtaagggcagagcaagaaggtggccaggccatctgcaacccaaggacagagacctcaccagagactggccctgctggtgtctgattttagacttccaacctccagaagtatgcaagctcgagtcccattgtttcagccagccagtctgtggggctctgtgaaggcagcctgcacaggctaggacagtgcccatactggctagatgcacagaacacgcacaagggaggcggaactaccacctggcttctgtttcttaagcagctcctcctgaaactgtcatgtcaaaactccatctgtgacaactgattggggacacttgcagggaacagtgaactgctctttgttctcgcggtgtgacagcaaacaggcagagtagacagatgctgtggggcggcaccagggacactcgctgctcagtgaggtttatcctggaacgacgttccttctcaaaacctcagaatgaaatcctcctgctcaatttcaaatccctgcagccaatctttacatatggagctttgaagactcacagtgttccaggcttaggtgtagacaggaagggcagggaagggtgaggactgacgctaggggaggcctcatggggagtggactccagcagtcctagaggacccttgggaaagggatagggaaggaactgtgtggatgcagagaggggtcagctactgactactgaccgtgggcaacaggtcacagggctgctgttagtaaggcagtcactgtcatttggataaagtcaaacctacctttctggaaaaagaaaaggaaaacattttaaacagtgagttgtgaaagctacaggacattggtgaaatcgcatctgatagggaaatgctaaaaagaaaatccagcttagggccaggagtggtggctcacacctgtaatcccagcattttgggaggccgaggtgggcagatcacctgaggtcaggagttcaagaccagcctgatcaacatggagaaacccagtctttactaaaaatacaaaattagctgggcaagtggtggtgcatgcctttaatctcagctactcgggaggctgaggcaggagaatcccttgaacctgggaggttgaggtcgtggtgagctgagatggcgccattgcactccagcctgggcaacatgagtgaaactccatcaaaaaaagaagaaaggaaagaaagaaagaaagagagagagaaagagagagaaagaaaagagagagaaaatccagcttaagcagaaaacagaaaatacatgtcagtgccttcttagatggttaacacgtagatggtaaacccagggtcactgtagctgagaagtattaatatttagggtctgttgtctaaggcggatttccagaaatgcctctcaggctctatccaatgcatacatttttttcatattccttggaatctgggaaccttcgctttctctagattttagatttctatcccagtgtttctggttgtgggatccacgccaatgaagcctcatttatctcctccacttcttgttagttggagttctgcagagaacttggacaatcaaaaaactatgggcttggcatggatgtgaacttcaagtctaaggaggtcaaaaccatctgaggcaggagcgcactttctgagtggggtgagatggagaaggtcattccacacctgaaagccatagctgggatgtggacaggaagggaaagtgtttgttcagcatgtgggaacttgaaaatataggtttgttctcagcatcacttacaaatgtgtctgaagcctatggagggatcttaggtgttggcagtgaagagggtacactgccatctgcggatggaggttacagtcagggtcacgcaggactcaggccctaacatgggcctggaatgcacagccctgcctgatggcatcctcacagctgtgctaacatgaaggaaattttaaaataataatggtctgagttcccatgaagtagatcctgaatatttccaccgctgcctacacatgcattatttcctcttgatgctatttttcctggcttcacacatttatctctaaaagacccatcctaatatgaaaacacagagtgtcttcacttagactgagtttcctattcctctggaaaattccatcagttgagtagagtgtatatgttttggtatatttgtctcaaggagagaagttaccagggaagagaagttagagggattaggttctttaggaaaaagactttgcccagatgatgtgagtaactcaagtaacaactataaaatctagacaacctttgttcagattcaatcattcactcatccatttagacagctgttatcaagtgccggccgtataccaggtcccatcaattctttcttctccaacaacgcagttaacaatttgaaaagtaaaagatcaaagagatgtataaaattatagaaacaggccaggtgtggtgactcacgcctgtaatcccagcactttgggaggccgagctgggcggatcacctgaggtcgggagtttgagaccagcctgaccaacatggaaaaaccctgtctctacttaaaaaaaaaaattagccgggcgtggtggtgcatgcccgtaatcccagctactcgggaggctgaggcaggagaatcgcttgaaccagggaggcggaggttgcggtgagccaagaccacgccattgcaccccagcctgggcaacaagagcaagactccatgtcaaaaaaaaaaagaattatagaaacaggggacattgaggattttgaacccttcagaccaacccctttttcattttcttttagttctttctagtttaattttcatatccgaggacaagaactctaggcatagatcacaagagtttctctgtgacattaaagtagatccttcaggctggttgcggcagctcatgcctgtaatctcagcactttgggaggctgaggcaggcagatcacttgaggctaagtgttcgagaccagcctggcctcccaagtagctggcattacaggcgcctgccaccacgcctggctgatttttgtatttttagtagagacggggtttcaccatgttggccaggctggtctcgaactcctgacctaaggtgatccttctgccttggcttcccaaggtgctgggattacaggcgtgagccacttcacccaggtttctcttgcaaattttaacagcaaaagagtagccttaacatgtttgggatctgttttgggagcttaatagttatcagtcttcaccacagcgaactgtgttgctggcattgtctccactttccagaggtgtgaactgagtactcaaaacacaaggggctggctccaggactcacagccaggaggaggtagaatgagacttcagtgcgggtggcccgaactctccatccctgcttcttaaccctgaacagaatgactccacaaagtaaaggcaagacaatgtcttttcaaaggtaactagatcttcatttcaggaaggcatcagggactccctgacccatacactactctggtttaaggtgtacactaaagcactcatcctgacatactctcctaccctgggactgttcattccctgaaaagcatgtgcatgacacaaacagggcacatatacaagatgcaaataagaaagaggagtgattcctggagaagaaaagaattttcagagatatctgctttacttaagaaaaggacgccaggcacagtggctcacgcatataatcccagcattttgggaggccaagataggtgaattgttttagctcaggagttcaagaccagcctggacaacatgaaaaatgtgtttacaaaaaatacaaaaattagtcgggcatggtgtgcacctgtagtcccagctactcaggaggctcaggtgggaggatcacctgagcctggggaggttgagactgcagtgagctgagatcatgctactgcactgcagcctggacaacagagcaaaaccgtgtctcaaaaaaaaaacaaaagagagaaaaaaagaaaaggaaattttatcacaattcagagaactgaaaagtgttcatttgaaagtctcactataaatacatttctagctctgtgcccaagaaaagatccacactgcacaaatgtgtgtcttgattactccactgcaaccccaccttcaccaggcattccgaggctcacacatcgccgggaaaaagttcccgcaaacagcttggtatgtcacctgcaccaagcgctgcccagcatagaggaccacgtgttctccattctcacatgataaggatttggacgttcaatgcattgttttattgtgcacatgacaaagagtatgctgtgcagggaatgaacagtcctgaagtaggacagtgtgtcaggatgagtgctgcaatgtacactttaaaccagagtagtgtatgggtcagggagtccctgatgccttcctgaaatgaagactagttaccttttaaacatacacatacttttaaacatacacatacttgcatatgtgtgttgcagcagttcctgagaatattctcaggctattcagcaggtgcctgtcaaacagataatcatttagtaaatattaaatgtatctgtctttttgtttggggtggaaatttctttattgcaaataagcgtggttcaagatattgctctcacagactcctttgaggacaaacaaaaatcattttgtctttttatttaatttaaatagttttgggggaacaggtggtgtctggttacacgaataagttctttagtggtgatttctgagattttgttgcacccatcacccaagcagtaaacactgtacccagtgtgcaatcttttctccctcacccactcccatgcttcccccagagtccccaaagtccactgtatcattcttatgcttttgtgtcctcatagcttagcttctagttataagtgagaacacacaatatttggttttccattcctgagttacttcggttagaataatggtctccaactccatccaagttgctgcaaatgccattttcttccttttcatgggtgcatagtattccatggtgtgtgtgtgtatatacacacacgcatatatacacatatacccacacatatacatatgtatatatgtacatatacacatatatgtatatctacatatgcacacatatacatatataatatgtacacatatacatatatatgtacacatatacacatgtacatacgcacatataaacatgtgtgtatacatgtatacacgtgtacacatgtacatatacacatatgtgtatatacatgtatgcacatgtacatatatacatatgtgtatatacatgtatgcacatgtacatatatacatatgtgtatatgtacatgtatacacatgtacatatatacatatgtgtatatgtacatgtatacacatgtacatatatacatatgtgtatatatacatgtatacacatgtacatatatacatatatgtgtatatatgtatatatgtgtgtatacatgtatatgtgtgtgcatatatgtctatatatatgtgtgtatatatatatacacacacacacacacaccacattttctttatccactcattggttgatgggcatttaggctggttccacatttttgcaattgcgaattgtgctgctataaacatgcatgcgcaagtgtctttttcatttcctctgggtagataaccagtggtgggattgctggatcaaatggtagttttacttctaattttccatactgttttccacagtggttgtactagttccatagtggttgtactagtttccatgctgttttccatagtggttgtactagtttacattcccattggcagtgtaaaagtgttcccttttcaccatatccatgccaacatctattttttttttatttttaatgatggccattcttgcaggagtaaaatggtatcaccctgtggtcttgatttgcatttccctgataacaagtgatgttgagtgttttttcatgtttgttggccatttgtatttcttcttttgagaattgtctattcatgtccttaacccattttttgatgaaattatttatttttttcttgctgatttgtttgagttgtcgattctggatattagtcctttgtcaaatgcatagtttgcaaatattttcttccactctgtgggttgtctgtttgctgattatttcttttgctgtgaagaaagtttttggtttaactaagtcccatctatttatctttgtttttgttgcatttgcttttggattcttggtcatgaactgttattctcaaatttacattttcagttccaggttctatttgtcacccacagacattagtcttgacagtcctatgcaatatgtggcatcaacaagagtaaacaggagctgggaagacagatacttccctctgctcacagcagcagaaattccacattagccagggggccccaagaggtggggggctggttcagaattctgagaaagaactgaacaatagcccaatggctgggatattaaaaagccagccataacacctcacaactccctagcaacacccttggggccacacagcctcaaactcctgagctcaagcaatcctccttggttcagcctccctatgaatagctgggactacaggccacactccttgaggagtgtaacctctgcagcaatctcacacttttccatggcatttggtcataactgtggtcactcacaggaacacagaaatagtgtaggaagacaaccaaacattcatgatggaaataaaaaaaaccagaatgctggtgtccttcttctagtaactggagacgtgcccaatgaaactggcttgttgagcttcaaacaataatctcccttaaacagcagttggagaattaagttctaatcatttaaaatcatgagcactgacttcttaaaacatactagtattctgaattaatgagaaaaggacacggcaaagaatatcaaatacattggaaattttgttaaatttgagttaaggagagaaggcagacacgttgctaagcccagttgggttctcatagggttactgaatcagagggctggaagaagccccattttcaagcccccagacatgactgtctggaaaccacttggatgaacaagagtttagcttcgttaacagttttttagggaggggcttcgtaattttcctctgcaactccagagttctatttataaatatgtatagtggttttaaatagccattattcccctacctgtgtgcaagctatgtgaagtttggggtggcttataaaaatacatataagacaaaatgataacataaataattaacagaataaaaatgaggaaacaagggccaaaaaggaattaagagatgaaagcagcccactgagtaagcttactatttatcctgctgaggtaggataccaattcaactctgagctttctactagccaaagcaaagacacaagtgcatctgatgacaaggtttgaggtattaataagctacatacaaaccagttattcagcagaaataaagctctccctgggttaagctttgagagtttttctcggggcttctcatgaagaaaactggattatgcagtaaacaatatcgttcccaacatctcataatacatctaagaccatcccgcaccgtgccaggcgtagctggtggcagagcaggacgctccctgcacacagtgctcacatgctgcagccacagaggatgagagacggcatgtccccagcctctcctccttactggctgccattggaaagatcagacctgtcagagaagtcaatgcaaaaacatgaaaaaaacgtgtaattaaaaaaggagaaaaccttgagagatgcagtgttatacatgcctctagtttcataactcccaaatttctagatttgatttgattttattgttttttaagagacagggtcttgctctgtcacccaggctggagtacagaggtatgattatagctcactgcagtctcaaactcctgggctcaagcgatcctcttgcctcagcctcccaagtagttgggactacaggcacgtgccaccacacccagctgttttttaattatttgtatagatggggtctcactatgttgcccaggctggcctctaactcctgtcctcaagcaatcctcccacctcagcctccccaagaactgggattgcaggcatgagctgctgcactgaaacccctaatttctagattttaaattcaaatttaccaacactaaatagggtcatgtttatgtctcccaagagcaccaaatgcactgtgggtaaacaactctttccaggcctcagttggttaatcttccaaccagtatttcactgttgactaatgatgagcatggctccagactctttccacgtgtttatgttataataaacatatggataaagcatttaacatggtgcctggcacatgaccacgccaggtgtcagctattgctgttagttcatttcatctgcacatctccatgacagaaatactcgaaagcaggagccttgttacagatgaagcacagagaggttggataacttgcccaagatcacacagccagtagtggaagaattgggatttgaacctagatagtcatggtctcgactccaagtacttcaccgccccactctatgcccttgcttggtaaatccgtgtgaggagtctttcatagacctaaagcaccattgaatggatcctcagaaaacttaatttcatcactattaagtattctaaaagaacatcttcagagtggccctgaagacagtcatggatgagggttacagacgtgagctgagcagggcagccacgaaggagcaaggcagggccccgtgggagacttggaaggtggcaatgtttatgtagagatataaataggttttgataagtttggtctaaaagaaatagtcatctcaatttgcagttaagcgttctatgcttctccccaaaacttcattgctgtgcccagcagggtgcatgttttacacagatgatgggcaaacattcttaagtgcaaaaggaaaccagacaaaaagtccccatgacgagacagccgagtgggagtgcatctgactctgactgcaggcccaaaaagatggaggtgaggaccaggacaggagctggaccactggggaagcagtcaatctaattttttaagattaaataaaataagtccaagatgaaagcctccttgagctgtcgtccatacataataccccttaaacaaaaaaaaagcggggttggtggtggggactaatattactgaaaaaacatactgagaaatgtaaaatttggtctttagtctttgaaaaacaaaataaacttggcatctgactttggttttctcacatcagagtctacttacagcgaggcaatttccgtcatggaaagaacccgcaatgaaatggcacagccgtggccattagcttgacaagcatggagcctcagcccttgtgagtgtgaatgggcctcatttatccaagaacggcactgaatacatcccagaggggcagccccaagctcgctggccacattaaatctgattcaccctcacttcagaacacttagcaggggcccactccttggagaaagtccaaggcaagtcagaatgtaattgcggaaatcaatatgtcttcttctttgagtcagtggaggcaaacccgctaatcctgtcgaaaatctacctattcttctagagccatcctccttcctaatcctctgaattcctcttgcacctggacacgactttccaaccccttgttctccatcacatgctggtgaaatgtccccgaactcttccaaagctttctccctcctgctaccagagtgctctcccccaaacagaaatgcaagctgcccatgtccaacctaacccccatcatggcccagagcccctccctagattctcctcagtgatctggctctggagcccctcaattcactcatttgtttagcaaatatctgtggagcatctttctaggccaagcactgccccaggtactggagttatatcagtgtctctattaacatggggctggcatttgagtagccaaagcccctctccccaactccatgtgctctgtgctcaaagaccacattccacatcaccccctagtctcttcccttcaggccttcacttttgctactccctctgccttcaaggcctatgaccacctgatacctgccctattcacctgttcaccacctggtacctgctctattcacctgtccatgctcacctctaggttctctacaagcctttcctgggccgccagagaggaatgtctcccttccaattgcaccattctctgtattttctcagtaagtgtctgcaggatgagtgagtacatttatgaatgaatcttccatttaaatattgagttccttatctcatacctgcagtgcaagagaaagcccctcgtgttgcagtcagaaaaccattgctgaccttggttgaccttagatgggtcacctaacctttcgaggctcaactccttcattcataaaaatgaatggatgctttcttgaggttgctgtgaggacatccctgagatgatgcctgtgaagaaagtctgcaaactgtgaagcactatacagattaacacagcaacatactgcatgtgcatggctgtgcatgcgtgtatgtgggtgtaaatgtgaggctttttgttcttggcaactgttcataactgtacctcggtgaactcttaggtaggtcaggaagctaaggtttactattgtgcagtgttcagcatgcaactgctttttggaatgtcactgtctttctgaatgttccttttggtttattaggttagttcacattaagaagaacttggtgaggaagccacatggaagaaatggaaaggctttctttggcagctctaccctaagagggcaaaggggtcagttctgcgagagaacccccacaaggaggctggcccgggacaagcattccaggcctgtctcaagtctgaatacaaataaatcccttctcaggtggttttcttcataaggatcctaaaagcatatacttagtcctaatcgactgagcaagctcctaatcaagtttcatagtgtgaatcggaggtcagtcaccacaaaaggtatttttaggaccccagacaaggaggggattgtctggagcgctgcagggtaatttgtgggtctgttttatttctgaatcagaggcagtggaaaagctgtttcagaccccatggctggagcagcgggtggagctcagcagtgattcatgtagaactccgggctcaaactgaaaccgtagatgtttgtcttcacagctgtgtgttatttttacccttactaaatattctctcttacacctggaatttcagcctcttcccaacagtcctgttccctcccccttccctgaagcagttgaagacaaaattaattaaaaagtcaccaccagctcaccaacagttagttctttgtccccttaaaggggctcgatgtttccctgagaaagtttcattatttaagtttatatttctctttacagccaaaaacgaatgccagcaagaccgtgttgcttttagatcttgaaaactggagggaaatgcaccattttgggattcatcatttgaaaacaaaatgttctgtagcataagatctctacaagcagttacatgacaaagatcagatgtgacatcttttctatcttgtgcacgtcttttaatttgtctgaaagactcctttttcagagaagaaaggattgagcccaatagccagtatggtgcttcatgtttttataacaggccaggtgaatcctggtaaccaaaacaattttactttctttttttcttttttttttttttttgagacggagttttgctcttgttgcctaggctggagtgcaatggcgcgatctcagctcactgcaacctccgcccccactgggttcaagcgattctcccgcctcagcctccgggattataggcacctggctaattttttttttaatatatatttttagtagagatggggtttcaccatgttggccaggctggtctcgaactcctgacccacctattatttttaaaatgtgattgttttggaaacacctggtgaggttaatgtaaaggtgagtgcaggtgaactgacctgatgtgataaagtaagatagtaataaatgtttctaaaatgtgtaacatatacaaaaaatcaaaatgcagttggcacttggatttggtgcatcttgtcactgcttgtctgacacgtggagagaaccttgctatccctctcaatgcaggaaagacgttcagcttcttctaagaagccctgagggagtgaagaagagtccaggcctgtggtcaaatggccaactttcactttcactaactttcacttgagcaagtgacgaaaacttttggaaactcagtggtcatccgtaaatgtgaataatcataataatgtcatctcatagatgtttgagaaaactggacaatatgttgtataccaaaatctattaataaatcatgtgggttttagaaatatgggttaatattatccctttcagggtctttttctcctgcccaggtagagttgatggtaccctcatatctgttattgctgggccctgaacatcgctctgtactgaatgtgtcttatgatctcacagaatctttttcacctttggtagaccatgagctcctcttagttccttttttttttctttctctcttttttttttttgagacagagtcttgctctgtcactggagtgcagtgccgtgatctcagctcattgcaacctctgcctcccaggttcaagtgattctcctgtctcagcctcctgagtagctgggactacaggcacctgccaccatgcccagctaacttctgtattttttgtagagatgggggtttcaccatgttggccaggctggtcttgaactcctgacctcaagtgatctgcccacctcagcctcccaaagtgctgggattacaagtgtgagccacctgcacccggccagcttcacttaattcttaatccatctccatcgaagctaacacagtccatgatgcagattaaacactaaatacacgttggtttcctgcagcatttgtcaacttcgacactagtgccactcggagccaggtcactctttggacaggtgggggtgggggctgcaggggcgctgccctgtgtactgcaggatgtccccggcctctacccaccagacaccagtaacacctcccagctgtgaccagcagaaacacgagcattggcaaatgcctctgggggccacatcacgatggttgagaaccactgggctaatgaattaagatccactgagctcaggcaaggaggcaagagcctcttgttttacctggtgtttattagagagaagttcctgtccccagtgtctggggtgatgcttaaaaggggcccttaaaggggcctctatgctcatgaggattcctagttatggtttgtccgtaccttgtttggggtacattccccaagccttggcccatcctcgcttcctcttttcctcatgccatatgtccaacccatcagcaaagcacgttaattccaccttccaactatacccaggatgcgactgcctctcccaccctcccttgctaccactctcacccactctcacgcagatgtctcccatcctacacccacattttctcaggaagacttcaacacaggagccagagaggccctgcaaaatctaagtaacactatatccctcctttgcctcaagtcccctaatgatttctgaactcaccagaaagtgaaagtcaaagtccggcaatggccccacgggctctccaaactcatcatctattactcttcttcttggacactaaacagcagccacgatggcctgcttgttgtcctcgaacacctcaagctgacctcagggcctttgcatttagcattccctcctcttggaatattttctgctgtttaatcacgggcattctccctcaactgcctttgcagctttactcaaacatcacttttttgtgatcttctccagccaccttctttagagctgccatccgcttcacgtctttatttttctccttagcatttaccatgatctaacctgctgtgttttcataagtggtctgatgtcatgaccatcttcactgctagaaagtgaacttagtgaggcaaaacttttttgtatattttatcactctatcccaagagactaggaaagtaggtgctcaataaatattcattgaatgaatgaatgactccacgcataaacagtatgtctaaggccctgatggacccagcagatactccctactttttctcatctccatcacatgacaaatggcatgttttttaaataacatctataaaacatcctgctatctgacccgaggctggagttattcatggcatgcaatgaatctatcccagagagaggcaaggcccagatagcattgtctctcgctgcacaggcccagctgggcaaagcgccaatgtggcgggagggaaggaggtatttctcaactcaggcaaggacttctggggaacaaccccacctccgcgtagatcctcccagatcattcgctgggtgggtcacctttacccagctgctgggctttctcatttttcatctccttggatcgtgcaacagagcagtggttctcagactaccaggcatcggaatcccgcagagggctccttcaaacacagcgtgctgggctgccacccaggtctcttccgattctagggcagggcctaagaagccgcatctcaaacaagctcccaggtggaggtgatgctgctggtcccggagcccacgctgagaatcaccacaccgggggaaccctcactcaacagaatcaaacatggcaatggctccaggtggcctgcagactgggctgaggggggactcacagcatggcacataaattgactgagttccacctgcagtgagcctccaggtgggcttcacgaaatcgccatcgcctgtggaaaggggaaggtgccacttagtgtaagctgcctgtgatctggctggcctgagctggggatgctcagatggaggaaaagcagcctgctctgcacagacctgccagcctgctcacgagaagacagtttgcttgtggaccatgagtgagcaggtgttacctcttggcttatcctgctagtctatcatgacttgagctttggggacctcacagcaaattcagggcattggtagggagctcacgagaggctgagcaggcgctgaaactcccagccaggcccttggtgtggatggcacaggaaaacagctggttttagtttggccacacactgacagttctccattgtgtgaacacttggggctttctggtgcgtgaggctagagtgaagaaagggagagggtggctgtggaccaccgaagctgaaaaatgatgtcctgtgtctacacaacgtgcaattagattactgtctgcaagaatgctgctgtttgatctggcagtggccaagccaaacccacaaggacatcccagttggctcgcaaagcagtggttcctttctctcctgtttttcttttattatgctttacagaaactctattataatggcaacagatctcgtttcaccacttgtatttcatttcaggagcttgtaagcacgttaggactgaggttttgtagaattccactattcggttgggaactaagtccttcctttctctcaaagcacatggcctttttctccgtgggtactggatggatagggatggacagagggcactattcccaagctgggtattctaggcagaaggaggtgggccatgttctggaaagacctaagctgcagagagtgcacttctcccgtggaggtgtctgcaagatagtcaggggccacaaaggtaacagcccacaagttctagccaaagagtaatatttgacttacgtaacttccccttggacttgacttcaagtggcatgtgcactacaggaaagcccattatgcataagctaagaggagggacaattagaagaagctattgggccaggggccaggagatgggctaactccctggcacagctggcctggggcttccgagtctggaaggatgcaggtgcaggtagtggagcgttgaggagctgcactcctggcggggctcctccagaggcaggcagccacacactgctctgcagcatctcatctgtgagcccctccgtggcagaatctgcgtctccgtgaaccctgcctctgccctggcccctcgagctgggctgacacagcccggtgctggttcacggtgtccaaaataaagcagagtgaatcacgcccatgttcccttttatggagctgcacctgacattcgtaaagagcccatagtgaggccgggcatggtggctcacgcttgtaatcccagcactttgggaggctgaggcgggtggatcacctgaggtaaggagttcgagaccagcctggacaacatggtgaagccccatctccgctaaaaatatgaaaactagccactcgggaggctgaggcaggagaatcgcttgaactcgggaggcagaggttgcagtgagccgagattgtgccattgcattccagcctgggtgacaagagcaaaactgtctcaaaaaaaaaaaaaaaaaaaaaaaaaagcccacagtgagtcagcaaagcctgcggatgggatcccaggcagtcctttgtctgccccaaggctgcctccaacctctggctgagatgagtcttagctccactgataactgttcagctttcttttcccccattccccttcaggaagcccgttggattgttaatagcagaacactgactcaccacttatgtttcaattctttcagatcactgagcttgagcagccccctagtgaacctctgacctgacacgccaccccctttaccacccgctgtccagtcaggctgagctccagcagcagcggtgaactggccccccagagcacactggtttggagatctaaaaagtacaatgggtcaccagtcactgatgagtgcagcatccctggaagtcaggtgtgggggtcagtttcctgtgtcaacttggccaggccgtagcacccagtgacttaatcaaatgctaactgaggttgtactgggaaggcatttgcacaggtagctagtcagttgaacttgactaaaggagatgatgtcagataatgtgagtgggccttgtctaatcagttgaaggccttaagaacaaagcctgcggtttccagagcagaagaaattctgcctactttccagcctgccagcctcccctgcagatctcagacctgcccactcccacaactgcattagccaattccttcaaataaatatcttaaaatgtaaaaatatcctataagttctatttctctagagaatcccaactgatacaccaggccagcacccagacacaatgccaggagacacactgagctctgggggagacgggcatgagctctgtatctttctcttctacaaaggggattagtgtcagccactcctctccctccccctggaacatccttgtgggtaggggacgatgacacttggtgactggttgacatctgtacattgctagatgcctcaaagcggaggcagcctctgcagccagtgttcctcccctgcctattacaacccagctgcccttttcctcaaaggaggcacgtaggcctggattgaaggcagatgaggtccaccttgttcccttcatgaacagcacctgccaaaccgacatcaccgaacccaccggaggacccggaggatgaagaggatgacatgatggtcttcactcggtatccacccaccaaaacacatcaccgatgctttaggagctggaacagcattgaaagtttatgacggcagcaatctgggcaatgttagaattctatgagccctgagagaggaactcttaaagttcccattgtttccttgaaagaaaatgtcaaggccgggcgcggtggctaacacctgtaatcccagcaatctgagaggccaagatgggtggattgagttcgagaccagcctggccaacatggtgaaaccccatctctactaaaaatacaaaatttagccaggcatggtggcggatgcctgtaatcccagctactcaggaggctgaggcaggggagtcgcttgaaccccggggggtggaggttgcagtaagctgagatcgtgccacttccctgcagcctgggtaaaaaagagcaaaactccatctaaaagaaaaataaaaaagaaagaaaatgtccagttcccctgaaaaagatgtttcccggaaagagaccctcagcgcagcaccagcctttcacttgcctgacagaaaaaccacccaagagctttccccagtctgctgcgctgagggccctggggcggaactgccctggtgtctttcttatggactgaagctcctggtgtctttctttcttatagactgtagccccttgcctggggctcagggttaccccaaactcccaacctgtacccctggggtcacaacacaggctggaaaagcttccccatgcctggccaggagggagaggagacatcagctaccaaggggcatcacaggctcacactaaggaaaacagtgtttgcacttctcccacaaacagaatgcttatttttttattttttatttttatttttttgagatggagtttctctctgtcgcccaggctggagtgcagtggcgcgatctcggctcactgcaagctccgcctcccgggttcatgccattctcctgcctcagcctcccgagtagctgggactacaggtgcccaccaccacgcccggctaattttttgtatttttagtagagacagggtttcaccatgttagccaggatggtctcgatctcttgacctcgtgatccacccgccttggcctcccagagtgctgggattacaggcgtgagccactgcgcccggccagaatgcttattttattttaaattcgggagtaacacagtgagaacaatagaaactttcatttctggagcactgttctcgcctcctcactcagtctcccttcggaggcttgctgaatccagactggccccaggccagactctcaaacaagggccaggacatggctcactctgcctgttgtccatcggaaatcatctcagtgcccttttgtctgagatgtttccttcctctctccccaccttccaacatccccctcctccctgcaggtgaattgctcataggtagaaattagcctctgcagaagaaaagctttagaaatgtgtcccggtcttagtgtctccgccgtgatcacgctggcatatatgggatcatatgaccccacccaaaacagaattcattcagtgtttccaggctgtgttccaccaactgatctactgcataaacactgctgcattctttagaacatgattaccctgcattcttctgtgtttcagaaatatatatagttaatgatcaacagaaacattgtatcaaatgcataggatttatgggtaaaaaatatttacatgtaatcattaatttcccacaactttggtgtcctggacccatcattgcattttctatccaggtccttctgtaactccaggaatgaatctcttgatgagattcaaaaatatttacatgtaatcattaatttcccacaactttggtgtcctggacccatcattgcattttctacccaggtccttctgtaactccaggaatgaatctcctgatgagattcaagatgggcctgcctcgagttccacttaaaggaccagtgcggtggcaatatgtagcatcagagccagtgcactttcaagaagcagatgcacagacgcaaactgacttctcagagtggaggagtgttctggcatctcccatctccccatctggcacgtccagccttgccgttgacattccctctaggacactgtgacttggcaccttcattaacaccacactaggaattgacgcaaccgtttccagacttataaactatgacacttataataaacctttttagcgttaaaacatatatgtaacaaaaaggccccattacagcttcaacagagtggaaaatgctcagggtgtggagtcaaacactcctggtttaaatccaaactctgattccatttaagtggtgatttggggtcagactggaaatgcctgatcacaggtttcttcatccatcaaatggggtcaagtatacttcatgaggggctgctcggaggactgaggggctactggatataaaagggctttgtacacagtaaagtttccgaaaatgtgagctgttcttatgacctgatggtagattatgcaacatttcgaagaaataatctgttctttatcctaagatttgatattctttttcctgaatatatatggggtattagatcataattgaaattaattttacttttcaaaactacacagaattcaacactttttgagggccagggacagttctgcatttggtaatacattttacgtgacagttgtatgttcatgacaaactcagggaagctaataattatgggagacactggagagggctttatgtgtaagctaagaggaggaaaaaaaaaaaaaacaaacagcaggcattaagagaagaggaccgcagagatcagagggtggggtgagggtggagggcagacaatggagatccactagcaaattcaagtggcttggacatacgccgcactgcctggccactagctgacactctccctttgtgaaaacataagacggcattattttccaggcaatcaaacctcagatgaattctgccatatgtgggcaaggctcccctcccacagagccctcgtgcctgggaaatagaattgaacacatcttcaaagagagttcttggtaaatatactactaattttacaaactccatcctctacacaaaccactggagaacacattttcccagcgctgtccaacgtcaccgttcaatggcctttctttctttctttcttcttctttttttttttttttttttgttagccagagtcttgctctgtcgcccaggctggagtgcagtggcatgatcccggctcactgcaacctctgcctcctggattcaagtgattctcctgcctcaggctcccgagtagctgggattacaggcacagtggccttgctttctaagtcaatctttagagaagcatgactgacttccactttgcctttgcaaaggataggaaaatgggaggtcagggagagaaaggggcggaagtctccttaccttgagccattcacctggctagggttacattccattttgatggtgaccctggctgggggttgagacagccaatcctgctgagggacgcgtgggctcatcttggaagtctgtccatagtcgctggaggaggacgcggtcatctctgtcttagccaggtgtggcgttccgtaggcacactcaaacaacgactggtcctcactcacaactgataaggcttcctgaatgcccaaagaaacacataattcaagacactccaacagacagtcatgtttcaaaaagttgttgatttcagagtcctttctaactgggaccacattttagatcgtttttatggtctccatttctacctttcagaagaaaaaagtagcttgtttttctttcctcgggacagtaagagttagaaatgccagcctagaaaaacttttatgcaggtctcgaagcatcccaggcttgactgtggcagggcagcagaatatccactttaatctcaacttaaggaagttgaatttcaaaggtcttagaagacatccaattgcatgtgtcactatttgacaaatgcaatctataattcaagcagacagggtacagagcggtcatgaggattaaaaaaaagaaatctgaaggccaacacctaagcatctggcaaaattgccacattcctggggattttgcggaagagggacttagaggaagacagagggatcaatggagcaccaaagggcaaccaaccaaagatacaaacgtttccactctaagttattagccgaagtacagtttcaagtggtgcttccatgatggtgagcatctggatgataaatgaaccaaaaaaaaaaaaaaaaaaaaaaaaaaagctgtgaagtatccagatgcttccaaacagcaggatgtttaaaatatctggatcactgacaagctcttttttccccttactttcaattaatatcttcgctcttttgcatgatttggtgagaagaaatagcaatttgtcattgttggatcaatcatttttcgtggttttaagtcaaacaagtggttagccaatggctatgtttatattctacagccaatgagcaacggcaagtttgggaaatttcaacgacttaaatgatggcttgtgctgcaatgacacagagctgttgtgatacaatccaattttggttcttataacagacaaaaagaattccacatgaatgctcatttttatattagtcctttggcatcctcagtattgacatcaactagtgagaagcaaaggctagttgggccacacatttttatttaaaaaaaaagaaaaagaaaagaactttggaggcagagcaggggaggcaggggagtgtgggctgcgcagacccttccagtccaaacttgtcatctccaaatgagaaatctgagacccagaaaggtctagagctaatcttgaatgagctggccatgatcaaccaggggattagtgatgggaatgacttgtgtattaccatctgccttctccttgcccccacagccctatgatgccctttgtgacatttttttcctttgggacatgtgtttaaattagcaccctcttccccttctctgagatgacctttacataaataagggtgcttcccatcagtaatcacaccctagaagcagcccttctgagatggagagcttcctctccacccagaaggatcagaatttttaggaaacaatcacccccaactccacatctactctgtcgctcgatcctccacctgtcccaggaccaagttttttccttagcttcccaagtgcacaaacttctttgccagacacacggcactgagaatcagcaaggaggaagaatcaaaacaaactcaaacctctgtctctcaaagtggtggtcaggtgtctgtgctaaagcaaaagcccccatcctggactccataagtatctgtagaattacagccctgtgacaccctgggaaagactaagcctgctgtccaaacagtaatgcaaaatgtaccaaagagtcaggtaggccagacagagaaccagaatcaggcacaagggaaaaaagtcatcttgaatagacagcaaaatcaaactcatcaacaaccaaaaatgatacgaggcagtgacacagaagttgacagtacagaaacggcatcctagatgttagggaacctgaaattcatggctttctcttccagtcacaattgagtggccaaaacaaggaatctaaacacatagatgtgggtttcaaagtaaaatcagcaccatagacttagtcatgctaattaagacaaaaattagaccttattaaaaaatttttgcaaaacagatactcccttcccatggtggcactggctagtgtgttttacaggctcagaacaggaaacagagctgatggctgctgcctctctccttcctgggcctgagactcgaccaaggctcgcaggggaataacacactatgtaatgttagctttggctcacccatgatgagaaacatgaacaaatgtgtgatttatatcagaaattggcgaaaacaggttatatatataagaaacaggctaaatttaaaattacaaactaaaaaggaaatggctgcaacaataacaaacaagcaataactttaaagtattagtatttctccaagataaagtaagcttacttctgcaaacaaagccaatagccacaaaaatgtagtgtaagtttgaataataaaaaaaagaccaaaatattagaactaaaatgaagcttaagtgtgtgtttgtaggggaaggaatccattctcacatctggcaaagcattatttcagcacatggttttctaaagaaagaaatcaaagttaattgagatcgatttaggaaggaaaaaaccctcagaaatgctagagatgggggaggcatgcctcctttttttgcatcttaaaattcttctcacagctaatattgcacaaaaatgaggaagggaatataattcagaatattgaaagcaacccctcagttgcttttgttcattagaagggaaaaattctgaaaataaggaagcttcaggataaacacttcaaaagaggtgaaatacagtccacattttgaaaagacagagcaacccaaactatgccccaaagactttgttgattgtcactcaacaaaggctgctgaacacctaggatgaagtacagctcaggaaaaggaaacaaatgaataaagaaaatctctctcacatacacattttgggagtaagaagaagctgaggggttttcacagacccattcccacaacagcggtcactaaagttaagtgctgctcttcagaagcaaaccaaggcacagccctgccacatctttgtcctcccacttgacttggctgttggcaggtttcatcatcccttcggttaaagcttgaatggacacacgctgctgcatagggccctccctgcctggcagccctgtgacttcaaaggggagagaggatctagcccagtaggattaaaaccagaaaaagagtgctgaacacaggctgctaatcaggaccacatgagttctttaactccagctctgggagagacttcctggccttgactgacatgtctctccttccctgcagcctggctcctcctctttataactagcagatctcacctacctacttacctgcctgcctacctgccggccaaggtaggcagctgccttagttagcatgtatagattgttattgcagaaactctggccagccacaaggcttgggatctgcttcagtggctttataacagagaatattttaaacgtcaaaatctggcagatatgtggcataatcatttcatatgcctgcttctatgttactataaaaagacctgaactttagattggtgtttgccaatgtgtggggtgtttttttctgtagctccaggaaagttgggatattcccatcaggcaaatggcaggctaccaagctcatttttaaataacttacgagaaacacataattctaagcaaattacccccaaacaaaaggtactactgtgttagtactgtagtattgattatttcatttcaatacggaatataccaataacacatgaggaccattcctttggattttggtcatgggataacagttccagaaatgaagggaggtcccaccaggttatatttcatattataactctaaaatatgcatctattttcaagtaactagagtacaaaaaaggatccaaaatacattagaacactgaaaaagaaaactaacaaagttgaatgcatactgacattttcagcaaagtatttcaggaatcctgatgcctttctataacagatgaatactttgcaagatgcctatttctcaaccaaagtattagaaaataaaggcccaaaattgattctaatttgtgatccttatagctcataaaaatattacattgttaatacagagaatccatcatacttaacctcttttgaaaatttgggagtggtaaagtgttgaaactgagaaaatctttaagaatggtcaggtgaatttcacatctggagtaagcaaaggcatccatggtcctttcgtggttttcaaaaattaggaagatggccagaactaggcctctcgagaattggattatcaaacccaccttcaatgttttcaagtcttatatgctataattatttgataattatgaaaaacaaatggaacaactaagtggaacaagaattgtatgatcatgatcatgcttaaaaaaaaaaaaatcttggttcgggcatggtggctcacccctgtaatccaagcactttgagaggccaaggtgggtgggtcatgagttcaggagatcgagaccatacaaaaatccaaaaaaaaaacaaagaaaaaaaaatagccaggcgtgatggtgggcgcctgtagtcccagctactcaagagggtgaggcaggagaattgcttgaacccgggaagcggaggttgcagtgagccgggatcacgcgactgcactccagccgaggtgacagagtgagactccatctcaaaaaaataaaataaaataagaaataaaaaataaaaaaatcttaaagaagtccttgctgctatcacaacacagtgtggagatcattcacttaggaagccagcatcatcttcaatcaatagcctactttttctgtcagttttaatcccattacaatccaatacaaaacccttccttaaatttccctcacatataaccacgcagaatttggtacatcacttaactccctatattgccatcttttaaccactttcataaatagcttatccaccaaataaaccaggttaccttaagcactttcatgcaatatcctcttaaattctattttgttgattacaagatacaccacttgtcacattttatcagctctgaaatatgaaaatgaaaggcttatcctaggtatcaggcagcatttcttcttctctgatggcagataaaataatgggacattttatatccaatgacatcttacattttatgaaaaatgatcatttaatccttacaattgtcctataaggtcagctgtgattcttgcccacccatcagaaagtgcgattagagaagtaacatcaacagtgaggatgaggcagaaacagggtttgtgtctgtgaatggaatcattccccaaggctgtagactggccactacctggctgttactggaaggaagaagttggattaagaaaagtcacacggtggagtgttttggtgcctgctcttgccatgagagatggaatcacctagagagagacagagagagagaggctggtagagggaagagacagaagaaagatgaagggataagtgtccagaatccctggatctgggatggaataaaggatctggatggtaaacggagagtgctgggaaccagtaaggacttctctaggtataccatgctcttctatgagcctaggggatgtgtagcaatgggccctgcatacagttaatcatttcttttgcaatggcttaaatcaacaaccttgttcttttctttgattaatcagattattcagacacaaagacatggccaggtgttgggatgtgttcattgcaggtggatgcctgccttctcttaatgagtactatgcaggaaaactaggacaggtaggagtaccatttataaatatgctggagcctatgccactttgggcggcctttagtggatgtctgcagacctaaggatattggaaatctatctattaggctgtcgcaggctctattgtttatagtttctcttcaaggcagcacatatgcagtagatgcttctaaaaggtctagtatctaattgtatttggaggaggaaaaaacaacacaaacaaaatagacaatgcacttagagaaagctctgctctcccaccataagcctgacaaagatactccagtccttcaggagtttttattctaaatgtgtgcacttttgcaattctgatgccaccagtatctcattaaacaagaatcttcatctgaccagtgtgtcttttatttacaacacacaaaaaagcgaaacgtggtaagtgaaagaagcttcacaaagctgggtatgatcatttttgccccttcttgatatgattttcttttcttcttaattcttcagagaaggaagtattaacatcgtatattaaatgcagcatctagctttgtgttcacgtttttctaatttaacacattgcaattttagtccttcaaaactataaaaaaaatcttggattaacctcaaaggaaaaatgtatgtaggcaaatgaagtccatctaaagagagtatttctccaatatggtatcacttcagtgtcaaataatttcaccactcacaacactagtccagtgctaagaaatgagacccagaactagtgtccagatacatttgcacatacagatatacaaacacatacacatgcttacatatgtacacatatacatgtgtgcatgcatgcaaatacatacatgcgcaaatacatatatacatacacacacatatatacagatacgcacatgcatatacacaaatacatatataagtgtatgcatatatgcaaatagatacctacagaaatacatgcagatatacaatacataatgtatatacaaaaatatcatacatatgtatacatattactaaatacatactaagataataaggagagatgaaaatctttatccttattatctttattaatagaacgctttagaggactttcagatattctttatctttaatcatatccactagggcaaatgttgcctaaaagatacagagaacctggcttcttcccatttcacctctgctccttcctctctcatcctagaaggtgcttttccctatgctcagcacatcccttcagaacagacttagctggggatccatcccctccatgtccttcagccaattttcccggctctggactcacagactttctcagggctctgagaaggcctggctggtgccagcaattctctttgcccacatacttctcccctggccttgcctttattcaaatataagcattttcagggctggctcctctgtatgtctgcctctagaaataagataatttcttaacctcaaatgcttgttggtgttcatattagccctaggactaagacatcaggtgatattacagccccatcataatgctataaatgggatccacaaacttctattacatccaaatgaagagacgtgtttttgtgagatgaatggattgtgtagccaacgcccaggagttccagggagtttggaaaataattgccattggcaatatgtctgcagtcatactaccaaagagcgtattattgcagagtttcaccttcaatccacataggcttaaatagggacttcctatagctaagcaacctatgaacaaaataagacttactggaaaatgaacgtttgcaaaagaaggagggagcattcaatctggaaagcagaaactctagaaatattgtgaaagattggagcatggtagaaaaatgttaaagaaagaatagttatgtccacataatgaaaattagatttaaatgagccttgggagatcaagaatgtcaaccaacatcattttaaaacaactctgttttctcagtgccatgcagaataaacctcgaatgcatttgaaaggacaatgaactgggactctttgccctggcaaatgccatttaactgtttaagaaacaacatgcctgtgatgtgaatagcttcttattttcttctttaaagaatcgcttttttggctgggtgcagtggctcactccagtaatcccagcattttggcaggccgaggcaggtggatcacctgaggtcaggagttggagagcaggctggccaacatgatgaaaccctgtctctactaaaaatacaaaaagttagctgggtgtggtggtgtgcacctgcaatctcagctactcaggaggctgagacaagagaatcgcttgaacccgggagggggaggctgcagtgagctgagatcgcgccacggcactctagcctgggcaacaagagaaaaactccatcaaaaaaaaaaaaaaaagaagaagaagaatcactttttcttcccagtaggcttctttccttctttggagatgagcaaaaagtataaaaacatctgtggaaacctcctgtttgtatgttttacattggaatgggtgcaaaaaatacactcactattcctttacatccttctaagagggctgtttctactcttgacactcaatacttgtttttgtttctctaatcactgttatacgttactcacgaatattcatcaaaacccttttccttattttttatctagttttaaataattcatttgagataaaaagaagtttttctttgctttttttaatcactcagtggaggatgaacatgaagctgtaccaatggataggagaccgtctggtagagcacgggagccagggatagggatctgaagatggaagatgtgagtttcaagctgggctctgcccttgctctgggaatcacctgggtaaatcctttaaccctttcctgccccaagtgtgagctgagagcttgccagaaatgcagattccgagtctccagccctgctgagtcagaatctgctttgtaacaacttccccaggtgagctgggtgcctgctcacttcaacaagtgctgcattatccttttttgactctcaatttcttcaactataaaggtggtactgatggcaaccagctgccgagcagctctctcccaggacagttaaatgggccaaataatctagtgtgtgtaacaggtttcataaatcttaatattgtatttaaattatcatatgatagaagggtgatgtgactgactccaaacctctgcatgtgaaccatcagaattatccattctagtcatattattctaacaagccagatgcaaggaaaatcacagtctcttgtgtgcaaattatcacttattttttgtaagtactggattttcaaaccaagtatctacctaacagaggggaagggagatctagcatcttttacttcaagagcacgtctgtcactttgatttatagcctttttggtccctggtccagttcttttgtgggttttccattcaaattctacattagtttgtttaatgtcaattaaatcaaagctttgtgcaggaaggaatgaatcctggtacactccccagcgtgctgttggtattctctacataacaagataataaattaatagatataccatggtcttataacataatgttctttttctttctttctttctttctttctttttttttttttttacctagaatagcacaaggcacaaagttgatagccctcaaacttctgaagaaaagtcttttcttccaggatgtggaatccataatgctttctatgttaactttccctaaaaattgttgaatttttcataaacttctatgaggaagtgtttccatggcagtctggctaagaggttcacaccatcattctgtcctggtgatttttgaaacttacaagcccaggttgaaactcaggtgattcaaggcttgagaaacacaaaggccaagctcaaggagtagcaaagttgcttgcactttttttctattggcatggtccttctctgaacaccagggaaggggtggtgcaccacctctctcctcttcagaaggagctccgtgaaaaatcggcagttttatgcttggccctttcaaaacacacaaaggctaaaaatacagtgtgctacgcatctggaatgtgtctcatctgtgaatctctgacacatggattcattgttttcgataaaattccaggaattttattcatgagaaaattctggcacaatggaaaaccctggcaagcaaaagataggggcagcagatgtcctggcctccacccacaactctgtctctgcttttagctaattttcatcaggtgtcactctcatgccttcaaacactcaattcaaaatttcccataagacgggggtgagggggtgggggtgtcaaaacagccttaattttttaaataattggtacggtcccccccctccccacagacaggtgtgtcacaccaggttcaacatgcacgtgccaggatgcaggatgggcactttaagaagaagccgcaagaccacagggccactggccatggggctccaccactccgtgcccctcatgtaccaagtcttcaagctcctcgtctaaaatgagggtctggtctactgatgttttctaagactccattttgcaccaaaatgagatcgatttgtttaactagtaacatcctctttcagccatagccaggctgcagtctctacctcctccatctctgagcagacatgcagataaggtagaaatctaccatgtatggagttgctaaaaagttcctatgcatccaggttagatgctaactgcagggtctttccctgctgcccccagactttaattttcctcaatcttgtaggtatctccttctgtgctaatggtaagaagctagtcagcaccctgagagctagtgttatgtttttaagtgtggaaaggatctactctcttgcatgggaatatggcatctgttctacacataaagcacttcaataataataataaataaaaaaatttaaaaaataaaaaacacatggcaacatggtaataccaacagaaagtcttgtagaaactggggttctggcagacagaggagcacatgaataagtctccactattcacatgatggtccaggggtctccttcttttgctttctatccccatccccatcattgttggcatgggccacacactgtataacgcagacatgaacacagacgttttctttttcttagacgctgacttacgtagaaagagttagtcttcacccactgtgagggtccaatccctgccaaggtctttcttcagcttggtaagtgatgatgtctgactccctggggctgggatgctaagcctgtgcttttcagaagatttttccagcacataaatatatcctggttgctgcatggaaaggggactaagtagccaggtcatcagagccctttgctaatgttatacgctgagctcatgcttttcctatgacatagatgagcactgggtagaccccgtcctggtaacacttttcatgcactaacaagttggttgccagtgagacttgatttttatgactctgggagtgctgacctcaaaacctaatacatttgaactaggagagcaatccctccaacaatttcaaactacacatacttacatcacatccaatagggctcttttgccatctggcttgagcccctctataaatatgtctactttgaaagtcacaagcctgggcggggtggctcacacctgtaatcccagcactttgggaggtggaggcaggcagaccacgaggtcaggagatggaaaacatcctggctaacatggtgaaaccccatctctactaaaaatacaaaaaattagctgggcgtggtggcacatgcctgtagtcccagctactcaggaggctgaggcaggagaatcgcttgaacctgggggacagaggttgcagtgagccgagatcatgccactgcactctggcctgggcgaaagagcaagactctgtctcaaaaaaaaaaaaaaaagtcacaaatactctttgaaagtgtgcagagtcattcatatccaaaccatcaaggcctgcccaacagcctggtgacttgaaatcttgacgtgtacacagagtctaaacctcggtctttagattgcctccttactggacctctttacttattaagattcatccttgtggaggaagtgaggtcatggatgttcacatctatctttcccaggaagaaaaggaagcttcaagagctgggaaatgctatgcaccactgtgcaggttctgagcagcacagagccacctgtggggtgggcgggtaggtgagtagtggacatctgaccaccaggcgctgtgcaggactacctccttgcagagcaggtggggccttccaagttgcctactcatccaacctgcacagtaagccttatgggagcgtcatggggctacgcctacttcaaagagcaacttagctaaagggaaagagaatttgcacttgctctcttccactctagcagacttgcacttgtcgctatttatttgtgaacacagactcattttagattgacttaaaaataaaaaaaagtgcaaagaacagggcagctggaagttgggaaaccacttctgccactgctgaatctgaagccttaagctcctgaactggaaaaccagccgactggagcactgagctccctgggccctgtaaaagagcacactggccaggcatggtggctcgtgcctgtaatcccagcacttttggaggccaagacgggcagatcacgaggtcaggagttcgagaccagcctggccaacatggtgaaactctgtctctactaaaaatacaaatattagccaggtgtggtggcgtgtgcctgtaatcccagctactcggtaggccgaggctggagaatagcttgaacctgggaggtggaggttgcagtgagctgaggttgcgccactgcactccagcctgggtgacagagtgagactctggctcaaaaaaaaaaaaaaaaaaaagaatgcaccaagtagtggccagtcaggctcccatgggccttgacacgtgagatgtcaggcagaatttttattaatgaatctgatgccaattcagtatttctgcaatcacaatgcactttcgcaatatttatccaagcaatatttatccaacaaaaatatccaatatttatttatccaggatctcgcaaacgttcagtctagtttcactcacgtcagtgtctctaaccttcatactttgctttcaagcaagagtcgtgtgttggtctgggtgtccgaaggtgggggtggtagctggtgatgcaaggaaccaaaaattggccatacttacttacttaaatatttcacagctctttaacagattctcatctcctgctctcttctcttctccaaccttgccgtctggttctgacactgtcctgccacgattaggagtgagctttttggggttccctcaaacattcactcccagctggtctctttgttacctactcaagagcagttcatactgttggccactctccccttttttaaccctcttttctttggcttccatattcctgctattcctcctatttggttgacaattccatcccccatctctttatgccctcctttttctctcctcattctctaaatgtcagctttcctctgtgcactctcctgggccacttctctactaggctatcatttcttccaagccatcactcaggagccactccaatggcctcagcgctgccaggaagcgcagcgcatttaatttgaagggtgaaactgccttggagggatggcaggtgcatgcttaataacttgtttcccaaggccacataagtgtcattactggatgataattatcagctcaagagggaaagttctaagacagagaatgcaagatttctaaacaggtctaagacagttttccaatgtaagatttattatgtaacagttttgaaagtagtgtctgattccctgtctatatcctccagaacaatctgagggcatggttgccattacaatttactttgggggacgattttatagcacgtcttcacagacaacacgacaaacatctttgcttctgctacactgacaacctgaagttaacatttctgtacctatgtagccattttaatcaccccctaaactggttattccacagcccaggggtgtgggactgagtcagatgggctagagatacctttattcagaggatttagaagtttgcctcagagaaaggccatttctagtctccactagaaatcacacatatcttccaggaataagaatattctcttagtcataagttcaacaaatatgtactgaacaccttttctacttagaaacttgtctagctgcttctagattacatccatgacccaaaaccacaaagacacctatctgcataaggcttgtattctagcactacaagccacagataatttttgaaaatcaattaatcaaccaataattgatagggtaaatttataaccttgtttttcaagcctgatctcagggttagaaggtggtaagtgataagtatgaagaaacagaaggcagaactagagactcaggaaaagagaggtaaactgctgcttttcatttagagtggccagggtggtcctgagaaaacgcgaaggaggggagggtgtgagcccccatgcattcatgaagaataggccttccagccttggcaacagctagaacaaggccagagtggactgcgggggctgcacgaggaacaatgggaccaagaacagccagggaggaggggttactggaaaggagcgaaagaaagaaccaggaggtgaaccaggaaaggctgggggtggtagagccttgcaggccatggcaggaacctgggtgttgactcagagagaagtggagtctctctagccgtcttggctaaaagcccgggaattgtcttcttctgtgttgcactaatattttccatctcataagggttctgcaaagaaaattctttctatctttaaagttttattattttcaaaactaaatgtgatgagaatgcatatattgcatatgccatgtgtacaccaaaagccacacctaataaaatgttacagccatcctttgtcccacatgcaacgggaacttccattcatcatcacatgcagaaactctgggaactgagaatctgtacttttcattcagagtctgcaaggggtcacggccattttgaaaggctttgactcacacaggaaatacctcactgaggctcccacccacccatccactaatagggcagcctttagggaaactgacttgtggcaactgaaaggaataacggcaccaaagtattcccctgccctgaaatctctgtttacctgtggaccggtgatgggtgtgaggctgtaggttttaacgagctctgaatggcaaatggcagacaatggtgtcacttcctttctgcttaggaaggagacgtttggaaaaactgttcactgctgtgcttgcctatggagaacctggattcccagagctctatctggtagaacgtgtctccatattaataagcagtgaatcctcttttgcggctgaattttcctcaaggaagcagcatgggccttattactgccttaaaacccaatttcaatattcgatacatagtctgtgtattcatttgctagggttgccaagacaatgtaccacggactgaggggcttaagcaacagacatttattctctcatggctctggaagctggaagtcagagagcaaagtagcagcggggttgattcctcctgaggactccctccttagcttgtggatggtcatcttctccctgtctcttcatatcatcctccctctatgcatgcctgtttctgagtccaaattacctctttttataaggacatcagtcccactgaattaaggaccaccctaagggcctcattttaattggattacctctgtaaaggccctacctccaaataaggtcccactctgaggtcctgggggttaggacttcaacataactcagggaacactattcaacccataccatcctccaggaaggcagagaatgtgtccctcttcttcactgctgtatctccctgcctagcacagtgccaggtaccacactatgctctgtaggtcagtgattctccggagctctgtaggtcagtcattctcaaagtgttgtccaggaaccccctggggtccccagacccctctaagggcaggcataagcagatctgagaatccagctgcctccaattagcccagacattaaagagattgcaaaaaatgcaaaacaatgccacttctcattaacattttcttggaaaatagagttacttttcataaaaatatctcatttgtgttaacatgcaatgagtttatttatttatttttattttttgagatgaagtttcactcttgtcacccaggctggaatgcaatggtgtgatctcggctcactgcaacctccgcctcctgggttcaagtgattctcctgcctcagcctcctgaatagctgggattacaggcgtgtcccaccatgcctggctaatttttttttctttttctttttcttttttgagacggagtctcgccctgttgcccaggctggaatgcagtggcgcgatcttggctcactgcaaactctgcctcctgggttcatgccttctcctgcctcagcctcctgagtagctgggactacaggtacccgccaccacgcctggctaatttttttgtatttttagtagaaacagggtttcatgatattggctaggctggtcttgaactcctgacctcaggtgatctgcctgctttggcctcccaaagtgctgggattacagtcatgagccactgcacctggccttgttattgttatttttaaatgaatttataagtaaatgtttcaaaatttctgtttttgtttctaccaatagatataatgcatatacacaatttttttttaagaatcctcaaccaatcttaagaacgtaaaggggtcctgagaccaaaagattaagaatcactgccgtcgaggttttaagcttggctaggacacagtctgtacttactgaagtaacccacagtatgacagtaataagacactttatgaagaacatattttcagtagctaagtgtcatagaaaaggaagcttgttagccatttcctcaagttgacaacagagagtccttaggaaaataattttttaaagccaatattgagccttccaagactgcacatggtgatatgttaaatttggaatttatgcaacttaaaaaactgagagtcgggggttggcatttttgtgcatcctaactgacgagtgctgccccagggctctctaacactgcacacagtctactaaagaagcaggctgcccatcatgacccccacccatcagctacacagcacacatctgcttctagatgaaccttcttgcaagtggcctgtcttatggcaaaatcaaggggcaggcctgtaaagcggaccaggaaatgagcagcaactgcataccaccaacctgttgccaagctaactgtgcttttctggatcagaggcagcttgagacactggtccctggggctgagggactgcagagcccgggcacagactccctgcctatctcccagtgtgtccatcttggtacacctggtgcatctctggattggcaagtggcactccccaattaatgttaagggccacttgttttaaatataaccagattattttaatttttaaatgtgtatcccatacttggacactgaaaggtcctccctgtttacctgcttgctggggtctgtgcttgggtgtctcattttattataaaacagagtctcaaaggcatttaatactaagatcaagtggctgggcatccatcatgtgcagagcaggagcctgatggtggtgaaggctcattctgcatgtggttgactctaggaactactttaacagaggggaagaaatacactgggagaaaggagcaggagattcgtcagggctgggggaatactggctccatgagggcagagacttttttctattttttctctttttcagagcctgtaagtgtccacatatcatgcacatgcagtgcgtatttgttgcatgagctcctggtatgcaggtgccaaatgtcatgctaagtgtgtcgactggatgacagaagaaggaaggagggattaaaggaactggtgtgcactggcctgagccttgaagaatggggtgtactgggtaaatcaaaatggtggggagcatttccagatggagaaactgcaaggaaaagcatagaagtggggccacccctcgtgagctggggagggcccagggtatgtgtgctggttggggggaagctgaaactgaggaaattcccattggatccatagcctggttctggtttccacaggcctgggatgccccgtccagagtttgactttcagtctgcacgtaatccaggctttgtattcccacttcccgtatcccctcactcctttttcacacaccctttttatctatgatgctactggggtcatgggttaagaagtcctgtcgtctaagcagcaagggtgcatcaaagcaggattttctccattgattccaaggtgtgattcagaaatggtaaaaactccgaacactaggatgagcactggggatgggttcatgttttttttttatgaaataattcagaacttattaagaattcccttggcaaaccaaattaaatattaaacaactatttgttaatatgttactattggattctatcttagaaaagtgtaattatgtgtaactgaactttttgttttcttgtggttgaaccctgaattaccatgccttctggtttccgtgtttttcctggggaataggtcatatttcttacttccaaagcccagaaataaaagcctcacacatccatccgtagtcccaaaggcttttctgcctagtacccagagagtaacagcagtgcttcaaactatttgtggacaagaagtcctaaaacatcagacacactgtggaaagcaatttcatttcattaatacaattcataattaactgcatttattttattgtctaaattccaactgctaacctatcatatcgacgaattctttgaagttgcctttattctacaggatatgttcatttttagataatgctatttttcatatactttaagttctggggtacatgtgcagaacatgcaggtttgttacatagttatatacgtgccatggtagtttgctgcacccatcaacccatcatctacattaggtatttctcctaatgctatccctcacctaccctcctaccccccgagaggccctggtgtgtgatgttcccctccttgtgtccatgtattctcttgatcatctcccacttattagtgagaacatgtggtgtttggttttctgttcctgtgttagtttgctgagaatgatggtttccagcatcatccatgtccctgcaaaggacatgaactcatccttttttatggctgcatggtattccatggtgtatatgtgccacattttctttatccagtctattgttgatgagcatttgagttggttctgggttcatgttttaaaatctcaatttgctccctagtcctaggaatgatcttctccacctccaaggaatgcaagccccagtgcaacatggattcttcctctgtaagaggctagactccaaataatttgtcctgtttttgcctgtgggatgttacaagtgtaccctgctgtctgtaattgtgtttctgaagtgttctatgtaagtaggtttttgttagttgaattgtactttaaatgtgccaatcaagttccccatgaaaagagatgggcacagagactttttgaaaaattaagcatcccaagagaaaagccgatctgaaaagactacatattatatgattccaattatatgacattctggaaaaggcaagactacagagatactgaaagatcagtgtttgccaaagattagagggagggaggggtgaacaggtggagcactgagggtttttagggcagtgaaactattccgtataatcctataatgttggatacatgtaaatatacatttgtccaaacccacagaatgtccagcaccacaaatgaacgctaatgtaaactacaggcactgggtgataatgacctgtcaatataggttcatcaactgtagcaaatgcactccgatggggaatgttgataatgtgggcaaggctacgcaagtgtaggggcagcaggtgtatggaaatcactctatcttcctctcgggtttgctgcgtactaaaattgctctgagaaataaagtctattttttaaaaaatgaagtattccaattaatttataagttttgccacacgtgcaatgacggccctaaccactttactttggttctccgatactgaatatgtcactgtgaatatctcatcctccttgatcccatccccatcaaaactagagattgaaataaggagatgagatggccctccctgaccgccttgtgcctttcagaggaggtgcctgggctggaatggggaggagctaaggactcctgtgggattctgatgctgggtgtgaaactgtctgcagttagcacggtgttggagagatgagtgctagactttgtatttctggggactagtgataaatgctcattattatttatataattttaaagctacgtttaaatttgtccccagtactagagactttaatgttatattgaaataatacataataggctgcaaatagttatattcttgtcttgttgttgtccatgtatcagcattcttgtatgaatgaaactagaaccaagaagaaaatccatcactacaataatggtccatacattaaaacagtttaggctgtctgatggtctggggtgtgtgtgtgtgtgtgtgtgtgtgtgtgtgtgatatagatatgtatgatatatatgatgtatatatgatttatatatatataaatcatctcatcttgctcaaaacaatatcactcttatttaggtaggcacactggaatatgattttaattaattgaaaagtacagtttgtttcacatttgcaggagtggtttaattcctacacagtgtactaagatggcctctcgtgggctcatgatcctggaagatatactcccaaagtgagggggggtctatgttggaagcaaaaataaaaggaatttaaagaatgacaggtctgggaaattattcttatggatggtcagttcttcatatgataaaatagttatgacaaaccaaacaggcacagtctcatgtatgcactgatttgcatgaaccaactttacagataattgattcagttggttggaactacagtttcttccaaatgtggacaacttacaacagggtgggagccccaaactgtgaagtcatgtgaggtcatatacaaactgaaaaacagggtttctctactggaatgataatcctaccatgttacacttttccccaaaatgaaatccaacatctttcacctggcgtaagaagcccaacatgttctggcccctagaaacccttacatcctgcaaagagggactagagcttgttactcttattagctactcttaaagtcacagaggtagttaatttggcaaggagtggctacaaattcaagacatgtttggatgtgctgagaatcagaatccaatctcggccctcaagtcatgggttaaagacttggttttttatctatatgaggtcctaccttgtagttcaagcagaaacatccaacaaatgaaagcagaaacaacatttgacagctcaaattcaaaagcaagaggcttgtcaatgcaaaagtcttgtgctgcaaatgtttcaagggaagtatccatactctgaagtgtgcaattgaaagaatgacctgatattcttgcactgttgcctcaaacaaacctccctcctcctagctagctccggatcttttatgcatcatatagtacatcttcccaaaaaagcaggtggaaaccaaagtgtgcaaaaacacacattttccaagaacaaatgcattatactagcaagttatgtgtggtggggctaggtgcttctgcgggtgtggaggaggaggagagaaagaagggtcaggaggaagtgtgttgggtacagagacatggaaataagaaacaggaaccctgaaagacacacccgcggaggttctgtaactgtacatgtgctcttgttaaatcgccagtttcagaggactcagatctgaggccatatagaaatctattaatttgcatcttgactttggggcttccagtaacagtaagtatttgtatttcaggatccactcagcagaaaggccatacatattcaagtcacataataaattggtgaattccaagtgaattgtgaataccaaaaaagaaaactgattatgtgactttctggaatatgatgtagaaattgacctaacaaaatgtatatgcacacttacggcatgtgtgcatgagggtgtcatttatgtacacaggtcatgtgcacatccaactcatggccatgcatgctgtagcctgttacccattctgggagatatgtaagcctttgtctttctccctccagcttcctgccttcttaaaacatttcactggtcatcaaccaatgattgaagctgggtgcagaaaaggagaaaaggtgaaaactcctcttagtccacaaggtgacgtgttagtgcttcaagtgaaagggctgtggtggagagccagagaaagcccttaggtggaatgagactgtggttcctataggtcggcaccttcctccccacccggcaggtcagctcatcaattgcacttatctcccagctgccacagcctgtctcactcctttctctctcctgttgggctgctaccaggcctggtaaactattccgtagctctgtgcaatagaaaatagatatgtatttctctgaatatagagagggaaattggagttcacatggaatgcatactgtaaacttatttgttttctgaaagcaaaaattaaacttgaaaggagcaaagcttttcaaatttcccatagtgctggcctcaaatcctaaagatttttttccttgacaagaatcatgggatgaattggaagatctggatgctccattcaccacagttgatgatgctaaaacccatgtgacagcagaggaaagaattgaacattctaaagtcccctctggcaactggaatgccaggggagccttcaccatatacctcatcaagccaccccaacaaacctgccatgtcggtgaaaagaccatgctcactatgaaaatgtggcttctgccgggtgcggtggctcacgcctgtaatcccagcactttgggaggccgaggcaggcggatcacgaggtcaggagatcgagactatcttggctaacacggtgaaaccctgtctccactaaaaatacaaaaaattagccgggcgtggtggtgggcgcctgtagtcccagctactagggaggctgaggtaggagaatagcgtgaacccgggaggcggagcttgcagtgaaccaagatcgcgccactgcactccagcctgggagacagccagactctgtctcaaaaaaaaaaaaaaaaaaagaaaaaaaaaaaagaaaatgtggcttcaagaccagaactctagccctttgtccaaaaaaaaaccatagcccccgagacccctgatggccttgacatgccactgggggtccccttatctatttacattatagaagggcttctaagaagaatggtttcagtcagagaatccaagcaacttatgctaaagtccagcctcatcctcagaactctgggcatgcttgtttttaatgccatgtctatccatctgtgactcattaacgcacttagcaaacactgagtgactgactagtctatctctccccgtgataaaatttaaacgcctcttacaagacatgagtagtctacctacctgttacttgtatgccattacctgaaaaattcccatctgtttggatgcaaacttcacagaaactctgccacaaatgctcacgaacaccatcacatgggctgggctctagtgctttggaatatcctactttcttagaaaaatcgatgagtacatataaatataattagctgcaccttgattcctgcggaatcattgtattaactgctttgggctattctccttctttcctttcaggcaatattaatttgtaacaaacacattttatgatataataaattatctttcattttttactatcaaatacatggagaagtaaaaaaacaaaaaacccagaacttctaggcagctcttaaacaagtcttgctgttacttggaaaagtaacaaattcacaggtttattgtctatgttaataaagctgtgttggagtagtcattataaccttttacattccctcctgtttacagctcacagaatatgtttacacatgtgatctcattcagttgtaacatgatctgcataaattatgggtattaacacttgccatatttattacaacgatttccccagcaatttgtcttcttaattgtataatctatattgcaaacagatgtctgcagtttgtatatgcagctatgtactcctatggtttatgcatctacctcaggccattaaactgtaagctcctggagggcagggatgtatctgattcatttctgtatctccggaacccactgcacagctgctgaatggatacacatctagttacttaacctctgtgtccttcagtttcctcatctgtgaaatggctataatgattgcaggaacctgtcttctctgtcccaattgtattaagcaaaacacttaatacaatgtctagcatataataagcactctatgagtgttttctattattattattattattattattgttataattatctggagttaattgaattaaagttcaaaaagatgacctaactcatttgggggaaggtgatgaataaacggcagaaagaaaggaatatcagggatcttatatgctgatcctagctttgtctaatctgccaagctaagtcgtaagatttttctcttttcaaaatacttctgttaagctagtaaaaattatttacttgtaaagattccatgtgctgctttttctgtcataattgcatttaccttaccaaatacatattgaccatctacacagtggatagcagaggggccacagaaatgagtaaagtctagttcactctgcactggtatctcttttcttccatatttacattttataattacatttgtcaaactgcttcacaggcgaagtcctggaccaggaaccaaataaaattgacccagctttccgaccatggaaaactaaaagtataatcaactttggcaccattaaattctgtttcatttattttttccaagagtctattaacattgtcatacagaagtagaagatttaattgagtgtgtgcattttgagttgaaagcagatactaacaagaaaagctaacctggaagacatcttgtaaactgtttcatcagactggaccaggagccaggggagggtcgaggtgactcagggctgttggcaaagctgcagaaattgccactgggtttctctgtcctctaggcaacctaggctgcattggctctctggcctattattcattacggtttagttcaccacagaggttgccagtgagcagtgcataagattagagattttgtaaaaacatgttaatttgtatgaagacgaaaattggactatggagtttagtgataaaaatagataaacagttctgtcatttgatttaaatattaaaataagacaagacaaagcttttaaggaaatgaccacttcttggttctcaactagaggcaatgcctcttctgtcctgagcagatgggtgtttgggaatacgtggggtgacttgggttgctgtgataatgcaggggttctctggcaatcagagggagagggaggggcaccttcaaactgtggtccagatctacacaatcaggaaaggctgttcacctaaaattcaaccttctgttgagaagagcaacacttacggagctcatcaaagaacgacaaaccactggaacagttcttgagaccaaagtctcattcactctgggacatatccagttacataaatcatttatgttttatcccgtctctactttcccaagaaaccctgccacacattcatagtgaatatcaaacctaattaaagatcctaagcagctgagaaaattactcaatgaccaaactataattagtcttctacaagggagaaaatgtattcaaatcattgcttaattttgtttcatttcctcttacctgcacttgaccattaagatcaaaagtctgagaatttgtggccaaaaaaaatgaacatgagtcaaagtcacatctatttgttaataatggaaagtaattccttttctaattacacgtgaaaatactagtatccaacaaacctatttgtggaaaatacggtttagattgggaaggttaattactttcaggtttttcaatgtccaaaacacacctcagaactaacaggctcagacaagatctttatgagatcactggatcctccctccaaaagcttccccctcccctgttgatctctattccatatgctgcttcatttgatcgtatagcgtgtatgatgagcctgaatgcgggcatttgttgatttgagtattacctgaaacaaaagatacaccagaatgtaaaacccaggagggcagagactgttttcccagaacctagaacaactcctggcacataccagatgtaaaatcattgtagaaagaaagaaagaaagaatgaaagaaaggaaggaaggaaggaaggcatgaaacggtgcactattattgtatgccaccttaagtcactcatagaaaatactgcatgccagcactctatgcaatgggtgttacactagccattatgtaaagtcaatgacgggattatacgctgggcactttataatttaataaacacccttcaattaccgtctcatttgctcctccatgccactccacatagtatacgggacatattttaggatcaccagtttagagataaagacagaggttgtgtccccaaagtttgcttgcgagtgtggtatttgtaacttctaaaactctaactctcccctgaaaacacgtcctaagagtggtgaggctcccacgtgaggtggcaatattggttacccccgctgagctcatcacattgcgcaggcctccacagggcagctacactctacgataaggaacatgaagccctgagagtcaggagggagaaaaaagaaaatgaacgtttggaaaagggcattcccaaatcacaggagaaggggaagaaacgtgtctcagctactaagtttctcttttccatgacgctcaaagcagaaaatggctgcacgtgggcaattcgtgcgcttggagctcagacctgcagtcttgtcgtttgtctgccctgtcttggtgcatgctgggcctgacttttttatttttccatttcaaggagccccagcagggcctggaggaaatgagttttgcagcccatctcggcccttgagcttggctcctcggctgacctcggctccccgcctgcagacccggcatgaggcaggcagcaggcactgcggggcagaacttccgggacctgcaagaccagtccgctgccttctgagacgtagttctgaggtgtagcaagttttcattttcacagcataaaaccgtctacaaatacatacttcaaaatgaaatggaggatgcgctcaaaaaaaaaaaaaaaaaaaaggcttagagacacgtcaaaagggcacaggagctcagccaggtcaaataaattcccaaatttgactcacatcacttcagcctcatctggatattacccacactctgcctaggcaggcgaagcttccgtgggatcctctgtctttagtgaattctttcctttatcttgtccagcttttcattgctctttcagaaactgagcccatggttttaaatcttaatatgaccttgcattcaattatatatatacatatatatatatatacaaagctgttttttaaagacaattttaaataagaaaaaaataattattttagataccagagagtggtgaaataataatgattcaaacttaatcctcacttcacgtaggggaaattgactcaaatctgggagcatcaaaaattaagatgcatttacaaatcctaggagaagatatcctttgtaatctcagagaaaataattgagagagggaaaattttttttgaaagacgtggtttggacatattactattttgtgaaatgaagttaaatgtatggtacagatattaaagttcacttaagttttatctatataaagtgtgtgattttggatctaaacaggcataaatatatatatgtgtgtgtgtgtgtatgtgtacatgtttgcgtacgtatgcatgtgtatgtgtacatgtttgcgtatgtatgcatgtgtatgtgtgagcgtatgtgtgtgtaagtgttgtatatgtgtgtatgtgtgtgtatatgtatgtgtgtatataataggaagtaagttggaaaacatgagccaactgacttttttttccttagacagctaaagaagagtggttagaagtttactcacaagtaaatcttttaaggagcgtttacttcccagaaacagcaatgagatcttggaggggcaattcttgtcaactgtgcatcatcaatggagtttaactgtgagaggtaaaacccattgttggtcccgactccaccaacccaaatggtcatatctgaggacttcctgtggttctcccgcccccaccctctccacggcatttactgctcctgtataccctggacttctcgacaggaaatggcaaattcctcagtaggaaagccaagaagtgggaggtcacatggagactggaagttcattgcgtgcagcccctccaggtgacaggcgacaccgcctctgcatgttgagtgcctttgtgacacatgatctccttgtctcatgaccacaggcagcagggtcctgatgagtgccctggagagaactgtcctcccacccctgggtgacacagagtctcagaagccagcagaggtgctgcaccaaaggctcagactttcaccctgcctctcttctcctcaactctttgccctaaaaaacatgtgctttgagggtgtgttgaaaatctcactaagtcaaatgatgcctgtggggcagaaataacccttgctctgaaagggtcaccaaaaagtcatgagactcctacctgtatggaaggtggtgactatatagcccttgtataaacaaacaaatacggtgaaagacttggctccatttttttttttttgtctgttcgttattttttggagaaaacgttgtgataagaagcctttagcctacaaaaatgtctctagattaatgataatttatctcacttttctcagtgaaacagatgaatcaaagaaagtgaagcatcgtagacaatataggaccttcctgataacatctaacatttaataacgtgatcacagcgtggcggctctaaaagacatgcacatgtgaattaatgcatctaacctgcacactagctaccattatgcccattttaaagatgaggaaaactgagactccaaaaattaaataagttgcctagagcatcttgccagttaatgcaccagaattctaagccagctgcctggttccaaagcgcatgcccataaacgcggaacataatgcaccaaatggcctagaactgaaacgactgcaaaaataagtcaacatatgagaaactagagaatatataaagccagccccaccataatcagtggcaagggatgggagatgggaagaagggagaagggaagggaagctaaataatttcagtttttctctgtgcctttaattcctgtcccctgaagatgacacgctcattttagtagcaacccatgaccaagatgcattccccaagcttttcgcacctgacagaaagggactcggtgtccaggactgtgcccgattacaatcaaagcagatggacccttccttagggtagggctgttcttctgacagcctcctctgtgaaactagattataagaggatgtgctgctctcagacaccctctgcctgtccccgccttggggtccttgcctttgccattcccctggtccgcatcactcctccgaggcatttgcaaaccttgttctcaccttttctttgggtctctgtctgacaggccttgcctgatcatgttctctaaactagaggtcccgccccccggccacctggctctatcatgttccctaccttccctcctaaggctcctgacttcctgccacactctgtcttcgttgagctgtgatctatttgtcagtctcccccatctgcatccccctgattgacagcactgagtgagcccagctgtcctgctgctcatgcccctcagcacccatgagcctagtgggtgcccagtaaatccttagtgagtaaatgaatgagtcaatttccacacaccaaatcccaaagggataaaaagacattgcctttctgccatttcttggaagaattttttgagacaaactaaagaaaggaagctacttgttattaaatttttaaaaatctgcctactattttcaggcaaatatgtcatgatgacatctatgaaatctctgaaattaaagagaagcctgacgtttcacaggaattaaatgaagttgctgcatcacaggtgctccctgccacagggctccgtgtggcagcagcaaacagaactcctcgctgcttaggtgtagtccttaggaatgaaaatctgaacgtagtacgttaaaaaaaaaaatcttcaaaagcaaacaaagccctaagtgtcgctgtgtattatcagggcagggtcctcctcagagagaggcgggctgcaatcgcccctacacctttcaccaagtgcctcgcttcaggggtcccattgtctccacgtttaggtttaggagcctggctcttcgtaacaccagcgaaacatgttctcctaaagatgttccctgagatacaacaccactccgcattgtttcaccacataccagcattaatatcccagagtaatccaccctcctcttaacggctgatgacggctccaatggccatgcaaaaatcagttgaaggaaagggaagtcttgtcggaaatgagattagtcttgtaacgagtgttcagccctgataacccatctgggcacagaactgcttaaactggagagcaattaaccttcacccgacaagctctgtccaaccgttataaacattaaagagacagaatccttcccccctccttgtagactaaacaaccagatttgaaattccacgtaaacggcctctttctgcagatgtgcaccaacaacaacgtttagggggaaaaggtgggcaatggctctgttcataactctggtaacttttggccttggtgtgagtgggctgaggttattagcgtaaaaattaactggaggtatttccaataaaatcaccaggtttaggggactggacatagttgctttcatgcagaaacccatgtgtcctataggaacacaacttgatgcttgagagattcttttttcttttctttctttcctttttttttttttttttttttttgagacagagtctcactctgtcgcccaggctggattgcactggtgcgctcatggctcactgcaaccttgacctccccaggctcaggtaatcctcctacctccacctcccaagtagctgggaccgcaggcgaaggccaccatgccccactaatttttctgttttttgtagagacaaggtttcaccatgttggctaggttggtctcgctcaagcgatccacccaccttggcctcccaaaatgttgggatgacaggcgtgagtcactgcgcctggacttcttttttcaacagtagaaatatttgcactgggctagactctcactcactcccaattcctctcttccgacatttgcatgagtgatgctgcttgtggtcacagaagggagattttttttttaatctccgagaagttattggttttcatggggagcaaacctgtgatcttgcctttatcagcatttgccgtaaccagtcgagttaaccaagttgggccatgtgaaataccgagtggttagagaatctaccaggaaacctactgttaaaaataactttcacaacactgaagagaaatagctgaggtcacttaatttatcactcaggcatgagctttctttagcatcagttcatgctgagccattggcttgtttatggacatgatactaacaataaataggtaaagggtaagggccctatgacatagagctggctacaaaccaatgtggggtacacaatatgcctagcatttaaacaagaaaaaaatgtaaagtacatgcagaaagtcatatgagggaaccaaacctctatgttactgacctgttaatgtgactgcaactcagatttttttaaatagaaagaaaaaaggaaaacatatatttagcatgtcctaaacaaatttatctccccaaggttttagtgcaatcttcatgatgacctgagatagctatcaaaatagtccatcctaacattcgatcttatctctcccttgaacccagtttctctttttccagtaggtaagtcataatactccaggcctcagagacgtgtttgcacacaacgaggctgagcctatctcacttataaggatgacatatctcactcatgctggactccagaccggccccaataacagttttggagagtggcatggtagaggatgtgtgttacatgggaagtactactgtaccctgggacaagatatcctggcaacaggtcttgttttcatggtttgcatttacatgcttaactgttccttttcctgcctttgtaagactaagaaaatccttactgtacagagaaggaactgtgaaaatagagcaagtgggactgactctcacattgcagggatatgcaccatctccatttttgcagccaaattagatgcaagcccaggattccactggcctggttctcccaggaacactgggagtttcttggtgtcttagcttgaggtgaggtgaagatgggctatgggcacgtgagctgaccagtttttcatcctgtgtgcattggacgtagacaagggcacacacagacatgacaagaatccatgacctagctcctaatgtaaatcttctttcccaagacaatcttgcagagccctcatggtcagtgataagaggaacttcaatttttatttggaatctgacccatttcataagaatgagtaacacctgaatatttaggtgcagatatcaaagacagaagacaaaaagaaatcatagtgtttgacaataatattagtataggatgccgttttatgagttcagtcttaggactgtgtaggtgcaacgtgaagactttcctgaagacagccacatgaatcatttttcataggatgtaatcaccactgtcatccattagtccaggcttgacacatagaatgggggtgactggctgcctaagtaacaaactccccacgtgtgcttctgacgaactgtgtgggctgccctaagcttttgcatgtctcgacacttaccaagtaaaatgatgagataaggaaaaccacaacatcatactcagtatcttgtgaaactgaaatggttgcagagtaaacactttgccttacagtgattttattttgactattatgctggatttaacaatataatggttaatatccatgctataaagttttattttttcatcaacaaaactaattgcattggcactttcaaaatgttgtttgcacataaatgatttatacttaagtatgagtgtaacaatcttgccatcaggacctggtctgttgggagatatcagtgaatggagcctggctcttccaatgggcaaccgttgtttgttggtgaagctgccacccttgagacctgcctggtctccttcccacctgtagctggctaagtagtgtctccccacaattcacgtccacctggaacctcagaatatgaccttatttagaagtaggatctttgcagatgtaattaatgattaaaatgagatcatagattagggtaggttctaaatccagtgagagcatcctcataagaggctgagcaggacacacagaaacataaagaagaaggtcgtgggatgacaaaagcagagacggaagggatgcatctacagcagtctccccttatccacgggggacacactacaagacccccaggggatgtctgaaacctcagacaggactgaacccaactgccattaactggaacactttctgttccatccacaaatgcaataccttttccatcttaactaagcacttactatccactgtggtcatcagttttgcagtttgaggtgcaacggcaaaacaagcacagatttctttttatttcttcaaacttcaaagacagaagattcattcttactgtacatcttagcaaccacagcatatgatctttttccttgtaagtacagaactttcaccttttcactgaaagaaagcactttacggcttctctttaacatacccggaattgccaggatcagtcctcttgtgccttggggctactactgaataaaagaagggctacctacacataagcactgtgataccgtgacagtcgatcccataaccaagagggctactcggtgactaacaggcaggtagcatctgtagcatggatacggtggacaaaaggggaattcatgtcctgggtggagcagggcaggatggtacaagacttcatcatgctacttagcatggtgaacaatttaagacgtatgattcatttatttctagaaatggccatctaatatcttcagacagcagatgaaactgccagaaaccatggaaagtggaatcgcggataagagaggactactgtccaagccaaggaacacagggcttgcaggcaacccccggagctggaggaggcaccagatgcatccttcctcacagcctccagaagggaccaacccagccaacacctcgattttggatttctggactcccaagctataacagaataaatttctcttgctttaagccactaggttgtaataatttgtcacagctatcctgagaaactggtaacagtacttgtggatgctgtttttaacaaaaattttgccactttagggcactatatggcctttttttttttttttttttttttgccttatagagttaggtcaatttccaaaagtgctggagtttatgccaagaattaagtgactccctggttgcagtggccaaatagcctgaaattttcaaagtaatactaattttgcaaaacttttcatgtaaactcctttgcctgaccatgccctaatttttgtgattaggaaaatctggctcttatcccactggaggaaaagtgtctagttcatattctaatggaaatcatcacttgggaggtgttttgacaaacatctctcagttttgtttaaaaattatgttagaaattaagaaaaataacgaatggaaaacaaaatctaatttttggtatattttcctgctaacatttgtgggcaaattagttaaattatgattgtttcatgcatacttactcctccaacagcatcctagctctcttaggagttccttttaattatcctaaaaacagttaagagtatactgagccaaaatataattaggttgagaaacaatgaactcctaaatgaccaatcaagttttttccaacattttaattctcaaataaaggtcatttccttttatttgactccttaaaaactagattatagttcttctaggagaggaaccaagtcagatttcttttaatcacatacattgccaaatgcatgctttactcagggaaagatttcaatatgcatcatttattcatgcattcattcattcaggaaacagagtagcactttacatgcggacgctgtggaaacaatggtgatatgaattcttaaatgattaaagaaacagtccactaaaaatcttatcaagataatagaatacttcagattttatgaaagattacattttcattggcctatatataatgttttaaccagtaaggctcactaagttaaataatatgctggataatcttaaatttacagaagggttttcagttttactatttggcttagataagctggtagttacttgctaaaattaatctttattataaagcagatcatcttgaaactgaatacaaaaacaaacgtagctattattgaaaatgttatgctatctcatatccattagagatgttatttatataataagtactgtgttgtaatttgcctgattccaatgaatacagaaaccctcagtgtgaatcaatatactagacaccagcagacatatttaaaagattgctacagtttcactgacatttcaaagaggtgactgtagtaacaaaagaagaaaaatgaatagtccctatcatagcacattaatacaacttgtcactagttcatgtccagaaagacttattatataatagattgtcaaagttgaatatttcaatgacccaatgcaaatcctggataaatgctggtaggtgttgctgctcaataaaaatgaaagtggtgtttggttttgctcatcaaggcaagtgtcatgtagcaaaatgcaggctatgggttgcctggaaactgtattcctgcttttaatttacaagtgaaacattcccatccatggcctggaagggaccatcatgtactcggcagcactcattagattctgggcagcccccggtcatctgaccttcccaaacatagggaaaggacgtggatagacattttcccaaaaagacataataatgaacaatgggtatacgacaaggtgcccaatatcactaatcatcaggaaaatgcaaatcaaagacacaatgaggtatcacctcacgcctgttcagatggctatggtcaaaaagacaagaaatagtaagtgttggcgagaatgtgagaaaagggaatccttgcagactgttggtgggaacatggaatgttgcagacactgtggaaaaaagtatggaggttcctaaagaaattaaaaatagacctaccatatgacccagcaatcccttttctgggtactttcccaaagaaatgtaatcactatctcgtaaagatacccgcagtgccatattcattgcagcattactcacaatagccaagatatgaaaggaaccaaagtgtccatcaatggatgaatacataaaataaattgtggtggatatatacaacggaatatcatttagccttttttttttttgagatggaatctcagtctgttgcccaggctggagtgcagtggcatgatctcgactgactgcaacctctgcctcccaggttcaagtgattctcctgtcttagcctcccacatagctaggattacaggcacccacgaccacaccccactaattattaaatttttagtagagacgggctttcaccatgttggccaggctggtctcgaactcctggcctcaagtgatccacctaccgtggcctcacaaagtgttgggattacaagcgtagccaccatgcccggcccatttagctttcaaaaagagattctgccaattgccacattatggatgaatctggaggacgttatgctaagtgaaataagccacacacagaaagacaaatactgcatgatctcacttatatgtaaaatctataacaaacaaacaaacaaagactcaatggggaaatggggagatgtaggtcaaagaatataaagtagcaaatatgcagggtgaacaagtctagagatctaacgtacaccataagggatatgcttaataataccgtgctgtgctgtacttgggatttttgctttaagagtagattttaggtgctcttgccccacaaaaaaagaatgtgtaaccatgtaagatgatggatatgttaatttgccttcactatcagaaccttatcaccatcttcatgtatatcaaaacatcatgttgtacaccttaaatatataaaataaaacttttaaaaaataaatcaaaaagtcatagttcaaaccactcttttggaaaagtatggatttgttaatataagtggtatataacaattgtatatgcatctggggaaaatggactccatctttcatgatataaaaagcaattctcggccaggcatggtggctcacgcctataatcccagcactttgggaggctgaggcaggtggatcacgaggtcaggagattgagaccatcctggctaacacggtgaaaccccgtctctactaaaaatacaaacaaacaaacaaacaaaaaatagccgggcatggtggcacacgtctgtagtcccagctactcgggaggctgaggcaggggaatctcttgaaccccgggagagggtggaggttgcagtgagccaagattgcaccacagcattccagcctgggcgacagagtgagactctgtctcaaaaaaataaaaaatttttaaaaaacagcaattctttgtgattttaatatagggtgccagccacatcactgattcatgcactcactcatgcatttgtcatgcaggaagttatttattcatttatgaaatggacatttactgatagcctgctttttaataggcaccatcagcatgactgaaaggttacatgacaacagccacagaacttaaggcatagaactttaacaacacacgttttgagttactggtcttgacgcctggctaattttttgtattttagtagagatggggtttcactgtgttgcccaggctggtcgtgaactcctgagctcagacaatccacccgcctcaacctcccaaagtgctgcaattacatgtgtgagccaccgcgcccggtcggggttctatagattcttaatcatgattaaccagcaatatgataattcaatagatccctgctcacctcccctaaagaatgtgccactctaagtagttggttcaaaatagcttgactttttaacctctagatccactccagagaacagtggtctctccccattgcacaaacacattcatttatttaacagcatcacccaaagcataagaatgggaggaaacaatgaacgtccttcatttctccaactttaaattatcaaaactactgattttctgggctcacaaaaatgcagttgagttcagctgttgaaagtttggttaacatgtcagttgagccaccaaatggaataacagttgtaactctcttatgttttctctactgtcctcaaaggaatagcatgagaacaaagcaattagcatacattcaggagttgcataatgatgttttggacaatgacagactgcagataggacgagggtaccataagattataatggagctgaaaaatctctatggcctagtgacatacagctgtagtaacactgtagcacaatgcatttctcacatgtttttggtggtgctggtgtacaaacctactgtgttgccagttgtataaagtatagcacatacaattctgtacagtacataatagttgataatgataatagttgactatgttattggtttacatatttactataccatacttttcatcattattttagagtgtactttttctatttccaaaaaaaaaaaaagttaattgtaaaacagcctcaggcaggtccttcaagaaggattccaaaataaggcactgttatcgtaggagatgacagctccacacagattattgtccctgcagaccttccagtggcacagggacaagatgtagagatgaaaaacagtgatattgatgatcctgaccctgtgtagacctacgctaatgtatgtgtttgtgtcttagtttttaataaaaagtttagaaagttaaaaaaaaaatagaacaaagcttattgagtaaggatataaagaatgaaaatatttctgtacaactgaaccacatatttgtgtttcaagctaagtgagtacaaaagagtcaaaaagtttaaaaaattaataagtaaaaaaagttatagtaatctaatatgaatttactattgaagaaatgttttaataaatttagtgtaaatatacagtctttttttttttttttttgagatggagtctcgctgtgtcaccagactagagtgctgtggcgcaatctcagctcactgcaacctccaactccctggttcaagggattctcctccctccgcctcccaagtagctgggattacaggcatgcgccaccatgcccggctaatttttgtatttttagtagagatggggtttcactatgttggccaggatggtctcgatctcctgacctcgtgatccgcccacctcggcctcccaaagtgctgggattacaggcatgagccaccgcgcctggccaatatacagtgtttataagtctacagtagtagatagtgatgtcctaggctttcacattcactaaccactcactgattcacccagatccacagccactttccatcctgcaagctccattcatggtaagtgccttatacaggtgtacaggtgtatcatttttttcccttcttaataataataattattattattttgagatggggtctcgctctgtagcccaggctggagtgcagaggcatgatctcagctcacagcaacctttgcctcccaggttcaagcaattctcctgcctcagcctcctgagtagctgggactacaggtgcgtgccaccatgcctggctaattttttatatttttagtagagacgggatttcactgtgttagccaggatggtctccatctcctgacctcgtgatctgcccgcctcagcctcccaaagtgctgggattacaggtgtgagccaccgcacctggcctctactgcattattactatacctttcccacattttgatacataaaaaccattgtgttaagtgtcacaattgcctacagtattcagcctggtcacatgctgcacaggtttgtagcctaggagcacaggctacacttatagcctgtagcctacgtgtgcagccggctatgccatgtacatttgtgtaagtgctctttgtgatgtttgcacgatgaaatcatctaacaactcatttctcagaactgaccgggcatggtgatgcatgactgtgtagggaaatactttcacccctttagaagaagctataaataaccaggtataaatgcaggattcctttccaaagacaaatactggaaacaaacacaatcaaggaagataattgattacttcaaaaaaacaattgagatatgagagtaaattaaataagaagactgtgactaggataagtaaccaataacagcccataacagctaacattattattattgttgttattattatgagatgaggtattttgccaggttgcccaggctgacctcagatactgaggctcaagagatcctttgctttggcttcccgagaagctgaaactacaggcagctgccagcatgcctggtctgcaatttacatcttttgtacactacagcacgttactgttcaaagcacatacaagtattaagctgcttaatccttgcaacactaccaagaagtaggagttattatcatgactgactctcttctacagatgaggaaacgaggcacagggaagtgaaaggcgtggtgggacagggacctgcggtctggatctgcttcatatagagaaactgggttcttaagaaggaaaatgggccttaatttctaaatcgtaacaagttcagccctcactcctcttttttttttttttttcactatcctggaaaaaaaaaagaagtggatagaaaggtactaataacaatgagtttaatttctcaaattttattattctttaaaaaggatacattggtacaggagtaaagacaaaaaaaatcaaaaaagaatcgagtattcaaagacccttgatggtgtaacatcaattattttaattttgtttttaaaatttttattttctaaactcctataataattgtttttcaaatggggaaaaagaacgaagtttttattactgcctttctttctacaatatattattcaatggagatactgaacctgtatttgctacaggctaaagaaaataaaataaaacaatccctagccaggcaagggagattttcagagaggatgccaacagggtcctatcccatcaggcatccatgacaaatctgtctgctgtctggtcctgtagcatcacccaaatgtggttcaggcagcactggaaacaatacagactcaggagatcagggaagtcattttgcaaagaagcagaagtgtcaggaggtagcacctgtaaggatgaatgctggagctgtctcatggagtttcacagaaaggtaacaagctgcacaatgactgtctaggggcaacagatacataggaggaaagcagtcttcattcaaacaggatactgagattgacatagtgtgtcttccaacaagataagcaaaagtatgtgaagaaatgagtccctaaaggaaaatatctctttgggcaatttcacttcaattcaatttcatgttaaatacaaaatacatatattgaatatgtggataaaatcactagaatatattcgtgcaataacatctacgtgagacatgacagcatctcaccatgtctggcagtctctcggggtcaaatgcaatctctgccccccacctggcagtcatcggcacttatggaataggccaggcagaaggctctgttagatactgccttcttcccttcgcaatgcactgtcccagacttcctggggtgagagaagtgattgtctatgagagctagcttggagtgaatgaaaacagcatttaagaggctcagcattttctgatcgccaaagggggtacccttcaacatgaggtgacccagcaatgattggctgctgagttctttgagtattttagggacctgcaggagatctgggtggagctgtgggtttccgtgtgtacagtgtgtaaacatcaccctttggtgcttcgccagtgcttaaggggctcccaggtgctatttattttgtttagtttattgttcagtgttattgtttgttgacttgatctatttttttttctcctacaaaggggccagtctgcaaggacacatcctgtagatggctaattgatgatgccctattgtttagtgtgtgtgcactgtggttttatttgcttcggttcaaagggcctaaacaatgcattcgttggaatttagtaactgctgtaaaatcagcacagagaacaatctgtgagctgatattttttgtacccaaatctggtaatctctgcttgactaaagaaagcaaaatctaaaatgacctttcaactaaccatagaaaaggccttccattgaatctcaaagagacttatttttctaccaaatataaaaacattcgaattatgcatcattttccatgattcaaaggagacagaggtgcctacggggcatgttactcatagacaagtctattctagtctaatcacgtccccttaaaaatcaccgagtagatgacaccgaggatgagaacgaggtactgtaatcattactttagaaactttatatttttacctgtttcaagacagaattctcctagaaaatctggagcaacaagcttattccccttggagaggagataacgaataatggaccacgcattcggagagaggaagtttccactgggagcccttcctgcatcagtgcgtctctggttgggctggctatctgtgtaggaagtgaacgcaggaagtatctgtctacaaaccctttatcctcaaggtaattgctgtagcagcattttactgtttaccaaagcagtaaacatgtgatctaaaaaaagatgttttccatctccagaagaacaaggctttaaaaaatgtatacatgtgcttattttgtaaccagcttatcaaaattggttacaataggcttgggctttcaacagtgagtccatgaaaacagctcttgggatggacagaggtaccctcacagggatgcacaagaaacaaagaagtggcttccttcactagaatgctatcctagcaacacacattttatgtcttttctcctaagaccggcttaaccgagttcatactgtttggcttacaaagaaggtaaagtcaacaaaactatctatgttaattcaggttggtagaatgagtaattcacaaagtccaataactcataaaagtcacttacatttggccttggacaatattcttatttttacgtgactataaatatgcttccagtttaggagttcacacaagacaaagtgaaaagttagaactcaaaaggagatgtgtagtggctgcttttgctgacttttgcctggcgtaggccaagcctcctggtccgtcttttcctttgtttctttattccagatcaagcttgcaaacctgcaccgtcccagatttcctggggtaagagaagtgattgtctaggagaggcagcttggaatgaataaaaacaggtccaggaaggatccctcagcatttaagaggctcaggaggggtccccctcatcatccttgttgtcttttgtgtttttcaagccgccttccaggtggatagcgattgcaatgagagagaaagagtatggaaggagaataagaagaatagggagacacagaagttaacaacgccctgaatgtctccttccaggacctgctgtgcagtgtccggtgaactcaccagcaagcatttcccagccctgttttaagcaatctccaatgcagatcaggtgctcgtgaataattgggagctcactgtgtctgtcagagttcttactttataatgaagagataaaaacatgttcatcacaggaaaatggacaaattggctaattgaaaacaaaattcaattcacaaactgttgtagaaattgaaaaaaaaaaggtagggggaaatgcttttcatagattccctgattttagtcttagaagaaaaatgtatttggcttgaatgaatagtaaaattaactaactttgattgaggagcttatgtgtgccatatacagttctgggctcttgcgacttggtgaatctcactataaccctgtgaagtaggaactatcactctacccatttcaccgatggaaaagcctatctcctgtgaggctgtggcttgccaaaggtgaaatggccaggaagtagaacagccagggagtgaaccccaaaagccaggtgggagcccatttcccctgcccactgcacgagacccctccccggtttgaagatccgataggggcactgctgttagctccccctgcgtcctggcagcagcacagtcagcagatggtcactgtggagaaggcggagctgaccacctccattttcctataagggagctagggccaggagaggtgcgttcacctggggaagtcctgcagcatcaaactaaagctccgggccaccctctcccagatgggcctctttccacttccccttgccagcagctatatctatgcctcccatccgttgcacggaagataaggccaatcccttttccacagaggctattttaaggatgccacgaagaaatacagagtaccaagtgcctccctgggccaaagataaaagtgggctgtgctctctggattcaaccttcatgtttttgatgctctctggaaggtcagggaaggcacacatatcgtatggatccaaagaggactacgcaatgcaaaaccacatactttttttttctttttaacttggagcaatgtcttgggacatctacctcaaattgagacacaaactaattgtgttgacagattctaaagtgttgtttcaacagtttcttcttcctcaaaggtgagcatcatgtgcacactgtcaaaattaaaaaaaaaaaaaaaaagacccaataaaacccgatgaaacccaaagagcatggagatgagaaactcactgctggctgacgatctgaatgaatggccttggggggaatgtgaatgtggaggtagcagaagggtcctgtcttcagtgcttgattctgtatcaatacttggtaaatttaaaaaacaaaaaaaccagcaagggagattttaaatcatcaaggcagaaggatttaaaaagtggaatgtgttaaatgcaagagtgcgggatctttgcataaagttattatattttcaaaaattcgacaagcattgtttttaccaaacgtgtttaaagtaacagccctgaggttaatgttatgattggattctgatgtggcactttaaaaataaatcattttgcttggccttagcatttcttttcaaaatgtctctgtacttatctgtgtacaacagcagattaccgttcttcccagagtttaattccatgaacaccctgctgaaagacttgttaaggccttatggaaaactctgacctgcgtgttcattattgacgcccaagacgagtgcaaggaagttgatacttgggatgaggaaatttaaatcagcagctgatctggaatctggaagcactgccccttggatctcgccaaatatggaaagaattcttgtcactgagcaaatatagaattcagtgctagagttttacctcttgaattttctagaactttgttttgattagccacctagagtataagaattgctgcctatgggatttttcccagaagagtagataacataaagtaaccagcgataataattttcattatccaattatttcatgtgtctccataacacttaatacatcatgtttctctgcacagtaattcactatgtacagctagggtgaatagcaggaaaaaagagatcagatgataaagagaagggagacagatttgtgtgacttgtataagatacttcgcctctctaatcctttgtccttatctgtaagaaagcagcagtacccaggctgctgtgaggatcacatgagacattatgagagtttagcacaggacttggcacataacaagcagttattaggatgatgttagtttggattatgaattcaagatactacagctacattttttatactttcttaaacatcaatttaagtcaattttaattaacgttattttactaggagaaatgtctctaaaaacataagaattctatttgaagtctacaatgataattacattactctgatatcttaacttcctctttatgatttcaaataattaaaatttaagtttatgttttcaacaagtgcttattgaacctctactctttgccagtcactgttgaggacacagaagaaatggataagatatcactaaaaacagcttctgcgatatcagtgggtatacataaattattcacactcaacaacaaacacaagcaaagctgggagaatgtgctgacaggaaagaaaatgaagagtgggagagtggacagatgggaatcgatgtgaaattttataaaacatgtcttggccaagctcagtaggggaaatatgtggaaagtaagctagaccaaacagagaataaaagtataaataagaaaaaaaatccagaggtcacagtggaccactagccaaaatgggttcacagcaaacaaacaaaaaaatgtaatgaaatactaaaattaaagaagtacaaataaaaatgagattctgttcttatctgtcagaatggcaaagattcaaagagtaaaatattcagagttgttatgggtgtagtgtggaactggtctcatatgtggctagaaaaagggagaactggtataatccttccagagaataatctggtaattattttttaaattggcaaatatttaaatttggcaaagacttaaaaaatatatatacccattggctcaataattcctttctaggcaccaatactaataaaaagtattcaaaaaattaaatagatggtgtactgcaatataatgagtgaaacatcgcaagcagcatcactttatacactaggatattggttataaaatggtaatacatattttagatagaatataatgaaacaaaaattttgcttatcaaaaaatgttagtaacatgggaaaatgcttgtaaaacaatgctaactgagaagagcaggacaggtaggtagatacaaggccaaacagatacacacggtggagagacatatcccaattgttaggaatttgctgtggttggttaggatctgaacaatttatattgactttgtgatgacttttaaacgttttctctaccataagaattttttatgtttataatttatgctaaagaacaagatgtattttttgtaattcaggagtaaagaggagagtggggtattccagggtgctgttcctgccctaaccaggagcacgatgcagtcataggcctctgccctcctccagcagcctcggctcagaacaggacgaagccaaccctctctgaccagcaccacctcgggcgacccctggacgctccacctgcccctgtgtgtggtacctgccctgctacacctttaacaagcacccctgcaagctccctcctccttccttccctgtcctgtggctgcccagacccagatgtaccctgcctgggtgtgggaggccgcacatcagagcagtctatggctgtgggcttcacagctgaagctgggccgtgggaaatgttgagacgagtgagtgcagagcctgaaagacaatacggtagaaaaggttacatccgcgggggggcgtctgatggcatctgccatttattgaggatgggtgcgagacagggtagccattatgatcccattttacaggtgacgaaactgagatcagacaggctagctaccttgcccagggtcacaacaggaaggaagcaaatgcaagtgtgtctgcggccacgtaaggtgagagaagcgctatcaggggtggtctgacagaatccccaggccagggagcagttgtcctctatcctgtggggtcaaaggaggggacaagaaggctctccttgaggtagctccaaagaaaagaccccgccagagcacagtgtgctaccaaacgctggaacagcctggagactgtccctgtctcttctctgaggtttctcatttcagagaaactctcatccgtctggcttccccatggcccttactctgtgattctcttatgtatcagctgttaaaccaataaatccgccaaattgttgggatgcctataatggctttgggtctccactcccacagagggaatcttattctaaagttctaaatgtatcagtcatattttcctgaagacaacagaaatggttgtttcatttacttatttttatgtatgctttttcaagagttgttaacctgtgtttgtgtttaaataaagatctgttttgcaaaacaaaaactttatgagataatcacttataaacgtagataattaagaaatggttcaggctcagcacattgtctgagagcattgcagtcctgcactgtatttcatgggggaagaaaagcccacagatggagccattctcaatcctgctttccagggtcactgagtcagggtgcctggcatgcatgggtgcatgcacacacaggcagagggccagggagaactgtgctgtgtccacagagggcagcctggatcacagagctgaccaagaacggaagcagcaagttgttttaaagtagttgcctgtaaagccacttttcggcaaggacaaacactcagagcatgctctgaaatgacttatgcacagcagggcagcggcattttgcccctggccttccttccattctcccggaatccccctaaagtaacaaggactgacgcaattcgtatttcacttagccaacaggttgatgaaaaatcataaatctgtagctattaaactcattaatcacatccatcaaaattctgtgaggagttaactttcttcatataactcttagtcttaattaagtttccctcacatgtgatagcaaacgttcaagaagtgcaaatgtgcagacgtggcgtatataatgcaagctttatgtctttaaattaataaaattgagtcctatcaggtcgtgtttcaattaccatcaaaccttccaacctctgttaattcaaaaaaaagtaacttctttaggcaagtcatggaaatagcactagggtgccctcaggtctccaccaagccttgttagtaactttccatgtcctgtctgatttttaagatgctttcccctgatgctgctgccggctgctggctctctccacatccttcaatgtcagatctctgtgatgatggaaaatcccccacattccctttttacacattaagtatctttctaggatcagaacttgcaacctggggttcatgttctccttaaaaggtccggggagaggactgtatttctgttgtaattctatgtatttctttttaggcaccagaaagtattattctgagaaaggactgtaggcttcactagacttcccaaattgcagatggcattaaaaaaaaaggaatcaggaaagtctttgggaaattaggctaaaactcctaactgaagcacaatcgagttttcagtgcaacagcaggatccctgcagtctgtagcaaacactgagatgtttgtggggacagtggggccggtgaggttcagcacctctcaatattgtcagatgtcaccaatgcccaagggaagcaccaaaaccaatcagtgaattgtctgcaaaccatcagctttgttgcttccaagtctttactagaactcttaagctgatcttaaaattcacagacacttagagataaatgaacactctcacataagttcccaaaattcctttacttcttccaattgaaacattttgttcccaatttcaagttaccaagggaaaatgatggtaagaatcacaaagactggatacgaatatttagcttttcatagtgtctcatagggtcttacaaatgttaatgcaaaaaaataaaaactccactcaaatgcagaaaaccaacttaaaaaattcagagcatctgatacctaatcgactaattgatttatttactgaaacaacaaaaaaacagagtgcattgagactggaaattgcctctatggggggctgtttcctaattccagtggacagccatcattttccctatgctaacttgggctttgcgctaacgtaattgaaactgtagtcaacagactcaggacctcctttttccactctataaacaaggctgtaaaatcatctcattactttacccaggaaatctaacagaaacatgtcttaaaggaagtcacctataaagagggcctattttaacagaagattaaaaaaaaattcacctgtagtcattctaagggttcacttgggtacatacaataaacacataatgcaatgtaataaaatgttaaatcaagcatagtaccttagacaagtgtaaactattatttccaaaaaagtgttcagaaaatcacaaaatattcaaactttcaaaatagcttcatgtattcataaatgtatacttcaaattaaacagtataacacatttggatgttttgcaaaatgtacctaccttctaaaggatggtctgttatttcaatgtcctttttaatgcactgagttttttgggaaaaaaaaccacataagatcgtacccaagctattcaagatttacacagaatatttgatttaacatgcatatgaataaggatgaaaataagaacaaaaaaataacattttgggtcacaaaatcaagtaatttctattcatgtagctataagtagggcacattaactctcaattttataattcctgtctataggagccatatttcagcagattccaatccttgaagccaaagaaagaaaagtataaggtgaaagttcttggtacacagatttttaatatattattgaacacaccttgagaaataaaagctgaacttctcaaacacagtttctatggtacatatgagtcaaatcttctaatacaaacatttcaaattatgaaaataccaaaccaaagagtatttttgaaaatggcttggcccaattctgggcaaacttccattttcttatgcactttccaacaaactaaaagccttatgaaaacaccaccaaatgcttctcacctccgtgcagcaaaactaaagacatgcaacaaacacaattttcttttccctccactcagcatctgcttttgttgctgatttttcacatttctacaaatgtcacgaaggcatggtggcctttaaaacaactgaacggacccccattcaagactgcatgccccttgacttgtagtcaccattaaattggcttcatttccaggaatcaggccatatttaggattgtacctgtgcagatttacctccacattaatctctacatgctatctactaaaaacttaggcaaggaaatgcatcagaccaaacaccccacagcacagagaaccgaccggccattgctttccaatctccgcaaacctaaccattgctggaagaaatcttactcacagtgcacagacagtaggtattttattgaagataaacatatagtggaacaaaccaaattacccccatttgagttacgtgagcactcagttctcagcgtggatgtcccacaaatcaagtcaacatttgcgtcccattaccagcagccacttgccgagtatctcttcgcttccactgggactgcctggcatccctgatgctaaggagccactgaagagcctccaaatgtctgacattcacaaacgcatcttttgctttgacccgacccttcaacctctccgagtctgctgccttttctcagacacacatccaggcaccgttagggatagttagagaatctgaaaattcagaagcgctccgaaaagcctttccaaaagtaatccacagcactcaacagtgaatttagaaaccccaatttttttctgagtttgaagtttttaagccttgcggatggttggagtaggaaaaaggaaatttactaggcagtgcaaaggaaatcttgttgtcctctattgtggcagtgggggtgttgcccaaccctaacttatctgccttgataaaggaaaccaaagaaaagagtaacaagaacaagattttgtcaaattaaaaggaaccctttccttaccttaatagtgctggccataatgcgatcaagtttattgatcgttaataaatgttaataataattattgcttctctctgaccagaaagtagttttgatgaggttgtttagagcggatgagattgtgctaagtctgggaaatgaagtcagccaatggcaggaagaggtttctattggtcctggctgtccagcccaaagaaacaggatatttgggagtggagagataagagaccctgaaaacaatgttgtttttcttgatgatatgcagccaggagattttttttttttaattaaaaaaagaaaaggcatcaattgggatggggactgccacagcaggtgtgaccggtgtgccgccgtgtgacacactgcactgagaccaaggcaggatgcagatgtgatgggactccgcatggcttcacacgggctgcaagcaccttggagccaaggcgttgagggcaccccactgccctgggtgtcagcccttcgcagcccaattcttcgcagaattactaggacagaggacttgagctcctttctcctaaaaggaaactttgcaggtggagtttatttcatgttaatagatggccatgttcagtaacagccattgcctggctgatttttaacaacctatatttattcaacatttcatataagtgttccagaacagtttcattttctccttccaaatacctgcactttttatttgctctacaacaaagttgttgaaaacgcaaggactctaggcttacagtaaacacaaaaaataaagaggaaaaataaaccttcctaagtcttgttttcaagtatttattaaaacccaaataactgaagtgactacaaatgtcccggaatatcagtgagctggtctcactctgacagacatccatgttgcagacaacagatcctcatagaacttttggctacccagagatgccatgtgagggccccattacatgtctaaaatccaagctataagttcagggtcacaggtctgttttctcctcgaaggaagtacagcgaatgcaggcctgaacattccttagagggtttcaggactttaattactcattttcaggaaattgcttggaagaaacattttgctttgaatctagctacaggaacgcaggacccataaagaggtgtggtctcaataggcgaccccaagaacacaatagactaaatcctgagtcatctgacaattcctggttgcagagctggacgttcagtaaatggatttcactcagactttaggccggcatgtgtcagagttctgtccaccagcccaggtcattctggcttttattatatacctctgatttatcacctcatgttaggacaaaagaaggaggagaaggagaaagataaggggggaaagggagaggaaggagaggaggaggaggagggagggaagagggcgagaaaaaatggagaaggagaaaggaaggacagaagagagagagaaaggaaggaggatgggaggaaggagggaggaaggaaggagaaagggagggagggagggaaagaaagaaggaaaagaaaagaaagagagtatattgtaagaaaatcattctgtggaaatcagaacctaagttctcagcacctacattatgagggggtgttgatttccgctcttttcatctctgaacaatgaataagatggcaggctgattaaaattctgtttccccgaaaatttcaaagtcctgagctgttttatctgggcagcttccactagaattctggagtgcggaggagaaaagctctctcagcttccctgagtgtccttgctttttgttctctcctaagaagcatcaatgtaaaatgttaactgtggcctccacaacacatggcacctgattatgcctttaccaaacaccagctttaaataagatgaacgctttgctaatgaaatagccacggaagaaaatcctgtgtggtcccgcctcacccacgcctcgtggttgctaatccagccctcagttgttccctgcagcaggaaagatcagcatttctactgggacctaatgcttcagtgatgatttggccttaactccctggttcttgcctaatgcaaatcaaactgtgaagagtgggatttcttacctctctattttgaaataatttccaacttacagaaaagccacaagataatacaccaaactcctaataccctttgcctggttaactctgattgtctactggtgccaatgtacatcattttctctgctttctctcacacatgctctctctctctcaatctctgtctctctctcccatatttatttatgtataacatacatgcatgcatatatccatcattttctaactaataaaaatattgttttataagagacaaatttatttattggatactaaaaaagagaaaaacagatgctattatttgatcaatattcgatccataagttttactgcgtctaattttggaaatgcatacaaacataaaaagtgatctaataaaaagttaatttggggatactgagtggtaaattctgttccaaaattttacaaaggaaactcctcctcatttctaatgacaaaatgtttgattgattcctgttgtcttcaaagagaataattcttgatgtttcaaatggcatcatagcatccaagcctggtaatctctgactatttaatgtaaagtgttttaaaaaaatctttggctcttgataggacaaggcacatcttttttttttttttttttttttttgggacggaatcttgctgtcgcccaggctggagtgcagtggcgcgatctcggctcactgcaagctccgcctcccagcttcacgccattctcctgcctcagcctcccgagtagctgggactgcaggcgcccgccaccacacctggctaattttttttgtatttttagtagagacggggtttcaccatattagccaggatggtctcgatctcctgacttcatgatccacccgcctcagcctcccaaagtgctgggattaaagacgtgaaccaccacgcccggccaaggcacatctattaactagaatatagcagtgcagaaaccgtttcccaaatattatcctatggggaaattatctgaagatatagatatcactctagctttcctcacttgtaccccaagtctatgttattaaatggcctcatccctacaccacccagcagcctaagaaccaggctgcctttcccacctgatacctcctctccctagggaaatatgccctccaagccaccacgcggaccaagttagggggcaatctggcacacggcccctacctgaggcccgtcctgccatgagcctatcagggcagggtcctttttcactctccttgagatgcagtaatcaccacactagaccagcacagcccatacagtagctgtggacagcagaacctatgaataaagcacacatttcccttgcatgcttctctgccacaaacccatcccctgtgaatctgccaaaaccttccactagtctcctcacattttactccaaagaaagaaacaaaataatataacataaatataccataaattcactgtcacaataaaagaaacactagtatttatttatcctaaaatcatttcttcccattttctaaagatcgaacaagttctcattcttgttcccttactaacttctctgtatggaatatggggaggaaggttaggagctaagaacactctgaatgacagccacatggttctcaatgtaatacatgcgcagagcaaagagaggagatccgtctgaacctccacatctgtggggacacaacagaagattcactcatgactcattcacgtctttatccctgccctatacatccctacaatggaacgcccttcctcctcaaaaacattgcaggaaaatgatgtcgtagatgaacacttagcaatatggaaaactgctctgatattttacctggttagttaaaaaatcacagtatataggagaattatatccatagactcattttgttaaaaataaaaaggcagttggggatggccgtgcattctgttccaaagcatctgtgaacctgaggaatagacaccatgagcgaagctaaccttcccgagttgaaaaatgaaatgcaatggtggcagacatgtccaaggaatattatggggactcgatccctttatgaatcttgtcatagatgaatgtgtggagatgtcaactagttggcagcagaacagtattggaacggtggtaatacaaggaaatagtatcatcatattagaaactttggaatgagtataaataatggctgttcaacagaaaaacccatgtcccctctccaaagggcctgtttcactatatgtaaaaattaggtcatgtatgttttcatattagactttttgttaaataaccttttttttttttttttttgagtctcactctgtcgcccaggctggagtgcagtggcgtgatctcagctcactgcaagctccgcctcctgggctcatgccattctcctgcctcagcctcctgagtagctgggactacaggtgcccgccaccaccctggctaattttttgtatttttagtagagacaggttttcaccatgttggccaggatggtctcgatctcttgaccttgtgatccactcgcctcagcctcccaaagtgctgggattacaggcgtgagccaccacgcccggccaataaccttttgtaatagtcaaaaaataaaaaataaataaaaaggcaaagtaaaaatattgacagctatatcttataataccaatggcagagaagctttttgttttttcccctcttcttctttggttcacttatattttcaaaacataaatttgtaataaacataaattatatcctaatataaaaatatgtaagtaacatgcaatgttgttcatttttgtaaatatctgaaaaatacaggcatgttctgtaaaaagtgcagcccacaatacttgtaggtgtcaaaccttttagcatgcccaaatgcctgttcttttttaaatgtctacagcaagcatagagctctttttttttttcattttattaagaaaacccagaaacgctcaagagtttcgtggaggccatctatgcggcattaatccattcaggtgatattaatggccttttcctgccaggaactccagtgggcactcaggaagccaggattacagggctctatccagtcaccgcatgtctcggcattcgggaagcctatctcagtctcctcaaattctgcacacataaaacttcagagcctgggagcgacccatgaaacgcaggtttttaaggacaaaacaataggacaaaagtgctgtatattgtccttaagatgacacatgaatttaaaatgcatagtgtttggattattcatgagagccccgcaagaacgatgtcccaggggtttttgccaggaacatgcctgagattgtagataagaatcaagcatctggggctgccgcacaatggaaaactccagcactccatggaacttttccatctgcagcagtcggaggatttgcctgagaacatacgcggcatgaagacactctcagccctcaagggcacccagtcagcgctgtttaaggacggtttttctgttcacagcatacttcatgattacagcttcactccattggatacaactatgtgagtatgtgtgtatgagtgtgtgagtgtgtgtatgagggtgtgtgtgtgggggggtaggggagtgccatatcccccagcagcacattaagaaataatccaattacaatttaaataaccattgtttcaacactttctctaagtggtgaatgtattcttcagtctcttggttgatctgaactaatagaaaccaaggaaactgttatcacataccaaatcctcaacttctcaacaccaagttgcaatttccttaatactgaagcacacgtcagttcagttctataagctcccatggagcaatgatttcaataaacacaatttcataagcatcccacacgttctcaagtttaggccaattttgctcttactcaactccatatgactttaaaaatgcaggaatattaaaaccattatcaaggactccaaataggtcaatgtattatctgtggttttaagaaagaaacctaagaggagagtaattattttgtcaccattatttagcttaaaataacttttaaatgtattgttccaattattaggcttctccatataatttggaaaccattaaatgagtttcaacttctttgtccgtataactgggtatatctgagcatagatgctacagacatcacgttgccattggtgcccataaggcttcgtatgcccacagggcatataattaagattcacaaaagcatctgactggcatcccactctacccccgactcagatccaaagtatcctttcccaggtactgtcccctgtcaccatccttggccaaattgagaatttatcccaggttgttgaaattaattttgattttgattctagtcagagttttaaatgattttttaagaagtgtgtcaatctcacctataagatactaaacagcatcacttatttttgtcttaatctgtcactattttatgaattatttttaaagaaaatacagattacttcttaaagaaagatcataagtggcactataatagcattcaattgatagaaattgatgtagaagcctgcattaataatttttcctgctgctttctaaagttggcttttagttttcggttgaggtgggctttaattcagcatcacctcatttgatgatttatttactaatttatttccatcacaaatggaatcagaaatgaagcgaaggcaaaaaatctttgccacaaattcatttatatttgcatgagtatcaccaggctacctgcggatgcaatgaagccctatacccgtgcctgaagtcaggagcacaggacactgggagtctgtctcagcgcagtaactgctacatggtacgctccacatggtatcctctccacctgagccctcctcatccctcgccccctctccacacctcaccctctccacactgtattatctcccactgcaagcaacgcagaggacacagaggtgcagctgaagtgaaggcaggccagttcttttccaattcactcttatgaaaatgtgttaaatcccgttaaatgcaccgacctgaactgaaatgatgatatcagtaaatttgttgttgtcatctgatgcccacacagatctcagcacatgttttgggaaaggctgcagtgttcaaggagtactagaaatgttctttctgagtggactggccatgataagccaaagaatattatagccgatagggataaatcatggttttcccactgcgcggttgcctggtggagattattccagcctttatttacagctacaaaaataatcctgcctcaaggattttaggaagcaaccacctcctgcctaaagaactacactgcattgttgacttgccagctagaaaccagacatgagtcgtgcagggaagttccctttgaacggcttgaattgttgtcactagagggtgctaaatgcccctcaaaaaggcctttagagagaatactagtgtgcctaattcttgatttaaattccttgaattgacattattttacaaagtggtctcattttttacttgttaaaattaagatctaacatttataatgcagaaatggtgtttttttttgaaaaatttggattgttcattattatagaacataaagaaatacacgttttaggagcaaacatgaattacacagatctgaatataagattaaaggcataaatctgggggggtgagatttgtccatggaaattgtataattgttttatgccactgttaatgattttaaagcctgaaaaatttaccactttacaataattttagattgttcaatatgttcccaaatgtgagttgcatcaaattcggtaaatgtagagtatgtttgttttctctgtacacaatactgacgtcagtgctagtgcctgcctaaactcagacaccagtagatccttttccagaactaagtgttataggaggaatatggattatactgtaatatatcagatgtgaaaaaagcctcacggtcccttcctttctcaaaaaaaacgtgtagtattttggaatatgcatggagtatagcacttctaaaaatggtactttatgtatatatgaagtaaaataggccttaaaacttaatatacagatttccttgaaaataatcttattatacatttacactgactttttggtcatccaaacattatgcacttaagcaaaaagaaatataaccaattttgcaactttcctcttcctgcctttgcttctacttaaaaatatctgcagtatttccttttctcgccgcttccactttggttcatataccaaggaatcgtgaggtcaatgggtgacagttgtttgtctgtgttcacggctgtcgggcggggctgggtgtgggtaaggctctgaccgacatctgaagaggcttcacccactgcggtttaggatacattttcctctcgctctgccagtagaacagggaggctagttttcaatgtgttctacagaaggataattaaggcagtgtgtcacctgctcgtctgctatttttaaaaggaaacaaacataacctttgcatgtgagaggcattgcaaactagatgggaggaggcccggaccctgtaacagtcgtacattccggtcccagcttcgctggggtgcaactgcagataaaagacgctggctcgacaaaaagcgcccctgggctctgcattgccagcatgcacaatacgaattgctaatgatgagctggcttaggtaggaactgaggaccctgagtgcagggctaacctctgcttcacaggaggggtccactggcgcgcgctggaggcggggagccttcgtgatatttctccgaagggaagagtccatgcagcatcctgataacagggaccttggcttcatccccaactgctcggtgaccccgatgcgtcatttaattcatttgtgccaatattcctttttcaatcaaccagtaactttgcaggtttgttcaaagaagaaattaaaatgcattggagatggaaggcagccatcttcccggagccccagtgctgacactgggaggggaaccccaggattccctcatgactgtgtcagtgatggccctcaacaagcacttactgaatgagtgaatgaatgaatgaatgaatgaatgaagccggccacagagcccaggagtatcaggggagagcaatactggctgtgtcagtggctagtccaggagagcccttcaagagcccagagttcgacttgaacttgggactcccctgggatgggtgaggttctctcaacagcagttgacaggagggaactgggacaggcccagccagtttcattcagtccagccagctgtggctcctctttaggaatgtggccaggcccagctgtggccaaagcaccagccagtccctcagttctgaacagaacgtgcccagcatcagtgccttcatttgtttttaaactgcctgctgaccatccacaaagttaagatgacagctgggacttaagttgtgaggaaccagtggctcccccatcactctctctcacacacacgcacatgcacacacacagagacacacagacacacacacatgcacacacacagagacacacaaacacacatgcacacaaagacagacacatataaacacacatatacacacatgcacacacatatatacacacagacacacaggcaaacacagacacacaatggatggtatcgatatctatgaacagatgagagagagagacagagcaggaggtcatctgctccccacccctcttctccccactgtcaccacctctctcccaagtctagctgcaggccctgtgagctgtggaagtggcttttttaagctgtcttcttagattgagtcattgggcagtgaggaaggtaaattttctctaagaagcctcccaaatctgtatcttatgggatttccgtctcaataattgagctaatagtacctgtaagcaagtggatagtcaataaaaaaaaaataccggctgtaagaacgaatgaatgaatgagtggatgagtggatgagtatacatcctctattttgctggcatcatgattattttacagcagatttatctggatttcaatataaaataagagctcccatttgtatacaacttagtccttgtaattttccaaagtaactctgattaaaattatttccagccaaactatttaggcaactgggttggtttcacacgtacttatcagaaaccattagaatggtatattgattgcatttctagacatttgccataccaccatggcaactgtatttcccaagatggcccagtaggatgtcccatcatgcataaccttctataaagtgacattgactttgcttccatcagaaagtgaggtccacgttcccactccttgaatctgagttgggctgtgactacagcagaagttcagctatgtggcttccaaggctaccttggaaaggtgatagagcttccacctgattttcttgggaacagccactcttaaacctcagccaccatacggggagaaagcccaagccatgtgacgaggccatttgtaggtgttccagtcatcagtcccagcccacagccagcattaacccccagaggtataaatgaagaaaccaagatcactccagccccaaccggcacttgactgcaaacctataagagactccaagcaaataatatctatctcagcccaatcaagccctggaaccatgagagattctaaataataaagtgatcattgtgattttaagccactgagtcctgcagtgagttgttatatagcaaccgggcatcggcataccatcagaagattccttaagaagaaacttttgcaacgttgctacagcagaaaatattccttctgtatgatcattcatccattcatcaatcttgattggcattgcctatgtgctaagcattgtcggtcactggaggtgcagaaaagaagtgaagcagtattcagccaaacaaacaacttgcatattggatagagagaaaaatatgccaaaattacaacagtattttgacccaacagaaaggacataagaagggaacatcaacagttccttcctattcttttccaccctttttctttctaggctcattaaatgtagaggtgcctcagggtcactttgccccatgagagtagataccctcctctcccatccctaactttggtcttcactctatgcctgataccagcagctccccaggctcctccatgctgttggcaccccattcccattctctggaaacatctcagcccatcaacctcagattactttcccaaggagatgtgagaaaacttcaattttcccctttgtgacttgcagagaaataggggtggtaaatgagaagcagagggagagggtggggattcattaccttgagttactaaagagaaaagctctagtgtttagaaggtgctgttattattttctctgaaacattagctcctagaaatcagaggctctgtccctagcatggtctctaaggcttccaggacgccccaggggcttccctcagtcaattttgactctaatgagagccatctggaaggctgcaatggtgggcctggctgatcactggaggggccttcgctgtgggcacagggacgtgcacaggttcacagagtgtgtctccgtttctgggaaccatggtcctgtgtgctccttccccaaagaaagcaggagaaagaaaaaccacagtcctgagtgggattctccccaaacatctaaaaagcttctttaaagaagtcaagttatcataattaaactcacatatggaatgcctatagacaacgtgttgctcttccaatcccagggagctaggacacccaaaactcacctcccagacggagctaggatttgagatactggattccacattacttaaagctgttcgagcttttcatcaggaatggaaagcattaatgcgtctcacacgtcactctctgtttcatggaattcttacactggggagctctttttattttactatttttctttaacagccagaacactgagaagtttgcaaagaaatttttcagctgcctttagtgacccttaactcaagaggttttgcctaatctgtaaattggagttgaaaatatttcagtacttttggagtggggagctttttgtctttaaaagagtggaacgacactaacaatagggctatacataccttgtgcttctttgtcagttactgcaaaccaaaaccagatgtgaagtatcagcggctacctcgtagtgacccatggaagttgaggctaatccatatcattcttaataactcaaaactgccaccttttaaccacctaatttttttctcacttacaaatgcaaaaaaaggaattgacagtacacattgaaatcgattttcccctgaccacttacagattttctcctataagagccaggaataaaagctcactccattatatcaagcagccatcatctgagtatgctttagtttaggtgatcatcacctttaacaaaccaagatctggaaggaagatttctgatctttaacaaaccaagatttgaaaactagatattcctgtcatgaccttttcccaacattcagtatgtaagggattcactggattattagactgcttgtaaatgtaagaaaacatagaaggtttagtgtgaaggagttagcaacctaacaaatgtttccccctgaattttcaataaccttcctgaatttaaaggtaatgaatataaatgaagaacaaaatcaatagatataggaatgattcacaacctcccaaatgaataaatcaatcattccaccctacatttgaacattcaatcaatattttgtctatttactaaatctaagaggaactactttaacataaaactaaatatgaaattatttccagcattgaatattgtgttttgccttagagcaggcacaaagtggaatgcctatgggtacaaagctaggcattgattgatgtttaatacctacaaatacagcaattacactgtcatgctacacgagacttcctattcctacactgaaattagactgcacatatgtagggataaaagataagacacaatcatatcatatttcctcaaatctaagactttgggtggtaagatgtaaagcacatcatgatttaaagtatcactaggaaagaaaaaacaattctgccaatgaaaattcaccgtaatactttctaatcaatcaattttaagatacatcccaatttttaagcaagaataaatgtgttaaaattaacacaaattggtacacttgtgatacaacagaagcactaaaatgtcacagcaatagaccacagggtttctcaaccttggcagcatcaacattttgggttggttaattatctgttgtgggggctgccctgtgcatggcaggatgtttgctagcattcctggcctctacccactagatgccagtaacacctcgcagactccaattatgacaaccaaaactgtctttagacatggccaactgtccctaaaggtgcaaccaaaaactgtcccagttgagaaccactggaacagagcaattcggttttatcagccttgtaatataattgtgtgtgtgcactgtgtgcatgacagactgtcagcctaatggaaggtatattgtcagatgggatagattgacctgaaaaaatcacataaaccaacagctggtacatatacaagagtgtgtcctgcccatcctaacccacacaatgcaaaagaacctggatgaccacgagtcaccatcacaggagtttactatccataagtgtaaaccatccaagaaaagtgaaaacagattaaagaaaataaaaataaataaaccaccacacaatatttgggcctagccagataacaacaatgaaaaaatgtaatattttgaagtattggcaagaatgtggaggaaaaagcattgacattcgtgtataatgggaataaaataatttatcctttgtctccgcaattgatattctagaaatctattttttagaaatactcacaatagacagttataagtacaaaggatgtctgctattacactgctcagtaacagtaaaatatgaaaatacactgtacgtctttcaatcagatattgaataattatactacacagtattaagaatgagatagatattaatgtactgcatagaaaatattcaaagtataataagttttagaaaattatcacatatgtatattagcatatgcagagaaaacatcttaaaatacaaatttcagttttgaggtttggatcatggagtaactgcccccttttcaagtcaaacagttgagaaaatttaggataaaacaagtgtgtgctacctttgtaatcagataaagtattttaaaataattcacattataatatagaaatactgaaatgccaagaaaatttaaatatattaattaaaacctacgggccaggcgcagtggctcacgcctgtaatcccagcactttgggaggccgaggcaggcggatcatgaggtcaggagattgagaccaccctgggcaacatggtgaaaccctgtctctactaaaaatacaaaaattagctgggcatggtggcgtgtgcctgtaatcccagctactcaggaggctgaggcaggagaatcgcttgaaccagggagtcggagggtgccgtgagccaagatcatgccactgcactcgagcctgacaacagagtaagactccgtctcaaaaaaaaaaataataataataggctaccaattagactttatagaatacataaatatattaatatagctacaaagaggttgaagcttattcattgagacaagagtatttattgagcatcgactttattaaatacactgttagtaagataacaagtgaaacttgttaaaaaaaaagaaactaggacaaaagaaatttgagttgagttccccaaaaacagggaatattcagattgtaggggaaattgggtaaaggatttgtttcagcatgaaaggagcaaggagcaaagaaactaaatgggaggttatgctgagaagtatatcagtatgaggaaatatcttgacatctacagacaaatatttgttgccaattcattttgggcattgaggattcacaagaataattaaaaacacgtaatataaaatccttctgattagagcacattttatggcactgcataaagagatggctgtgggagtcatttatattttaatactaacttgaacaaggcttggttctgcaaataaaacagaagagtaaatatgaagtggagcacataataatgttactgtttctgtgggtgagcttccataggaaagaggcaaaggcatcaatctcaaaaagttagaaaaacccaaagaaagaagaagaaaaataacaaatgagaacaaaattgagaaaattgtaaataatatggtagagaagataaacaaaaccaaatctggttctctgaaaagattagttatgtgtaagtcactggtgattacagagagaaaagagggaaggttaaaataaccaaagtcaacaataaaaagggggctattactacagatgctgtagacattggaaggataatagaatattatgatcaatttcctatcaataaatgtgaaaaattagttgaaatacataattggaaaatataatttaccaaaactgtcaaaagaaaaaacacaaaacctgaactcctataattattaaagacattgattgaaaaatctcagacctcttaaaggacaactccaaaaataaaaaaataaaaaaaagaaagaaagttccaggccagacggatttatcagcaaattctaacatgcatttaaaaaaaaaaggatgccactcttacataagcttttcagataaaagaaaagaaagcttgataccaaaatgtagctagaaaattatttaaaaaggaaaattatgggtcaatttcatacataaacatagatgcaaaatcctaaataaaattctagaaaacaaaacccaacagtatatacgacaataatatatattgtgaacaaactggatttattttaagaatgaaagcttgtttcaatcaaataatcaaatttacattgtaaagaaaatttatataactttaaacaaaagaagaaaagcacttaataacattcaacattcatattaaaaattcttagtaaattagaaataaagaggaagtttataaatcctacaaattgataaaaggaatctaccgaaacctacagtaaaccacacattttcatgtcaaaactttaaaatttaatcatttgaagttgggggaaaagacaaagaagccccacatattaccgcatttgtctgaaattgaattggcagtcttagttagtaaagaaggcaaggaaatgaaatgcaatgttaaaggattgggaaaaagtaaataaaactttatttacagatgacatcatttttttacacagaatttccaagagaatttggaaataagtcattagaattaataaatgagttttaaaagtttgctagatacaaggtcaatatagaattttagttttatatatcagcataaacatcaatagaaatcaaaatttttaagtgatactgttttcattagcattaaaaataccttacaatatggacataaatctaacataatacgtgcagaacctctacaccaaaaactacaaaatattattaaaagaagaccaaaataaatggatagatatattcatggattgaaaaacttaataatcaaaggtagaattttcttcaaattgatcaatagattcaatgcagatgcattcaatatttcaacaaagtttttgtgaaacttgagtgattctaaaatatgtatggaaatgcagagtcaaaaacagacaagatgctcttaaagaagagtgagaaatacaaaagattatcagagactattacaaactggaaaacctagaggaaatggatacatttctgaacacatacaacctgccaagattgaatcagaaagaaactgaaaacttaaacagaccaataacaagtaataagattggataggaaaaaaaatctcccaacaaagaaaagtcaaggaccagatggtttcactactaattctaccaaacttagaaagaagaactaataccaatcctcaccaagccatttcaaaaaattaaagaggagagaattcttcctaattcattctatgaggccaacattaccctcataacaaaatcagacaagaacacaacaaaaaagaaaactacaggctgatattcctgatgaacatcacttcagttcagcatggatacaggccaatatttctggtgaatataagttttctagtattttgttcagcaaaagctatcaacaaaatattagtagcctgaaaccaacagcacatcaaaaagataatgcaccatggtcaagtgggatgtatcccagagatgcaaggatggttcaacatacacaaatcaataaatatgatacatcacatcaatagaaaaaaacaaaaaccatatgatcatatcaataaatgcagaaaaggcatctgataaaacttaacattgtttcatagtaaaagctctcaacaaactaggtacagaagaaacatacctcaatatattaaagtccatacatgattaacccacagctaacattatactgaacggggaaaggcggaaagtctctcctctaagaactggaacaagacaaggattctcatttttatcacttctattcaatataggactggaagtcttagccagagcaatcaggcaagagaaagcaataaaggtcatccaaactggaaaagaagtcaaattgtccctctttggagatgacatgatcttacatctagaaaaacctacagactccaccaaaaaactcttaggtttaattaaaaaattcagtaaagttgcaggatacaaaaaaatcagtagcatttatatacccaataatgcactggctgagaaagaaatcaagaagaaaatcccatttacaataggtataaggaaaaaatatctaggaaaaaaattaaccaaggaagcgaaaaatctctacaaaaaaactacaaaacactaatgaaagaaatggaaaaggacacaaacaaatgaaaagacactgcatggtcatggatcagaagaactaatatcattaaaatgaccacaccacccaaataaatctacagattcaatgcaatccctgttaaaatattaacgtcatttttcacaagaatagaaaaaaacaatcctaaaatttatatgaaagcaaaaaggagcctgaatagctaaaggaaccctgaacaaaaacaacaaaactgggagcatcacataacctgacttcaaaatatattacaaggctctagtaaccaaaagagcatgatactagtataaaaacagacgcatagaccaatggaacagaattgataacccagaaataaatccacatattcacagccaaccgactttcaacaaaggcatcagtaacatacattgggaaaaagacaccctcttcaataaatggtgctggaataattggatatccatatgcgaaagaataaaactggacctctatctcttgccatatataaaaatcaactcaaggtagatgaaagacttaaacttaagaccccaaattataaaactattaaaagaaaatagagaaaacatttcaggacattgatctaagcaaagatttgatggctaagacctcaaaagcacaggcaagagaaaacagacaaatgagactatattaaactaaaacacttctgcacagcaaaggaaagaaaacaaccagcagagtgaagagacaacctgttgaatgggataaaatatttgtaaactgttcatctagtaagagaaaatccagaatatacacaaaactcaaacaactcaacaattaaaaagaaaacttttacaaagtgggcaaagaacgtcaatagacatttctcaaaagaagacacaggaatggccatcaagcatatgaaaaaaaatactcaatatcactaatcatcagggaaatgcaaatcaaaaccacaatgagatatcatcataccttagttagaatggcaattattaaaaagacaaaaaataacagatgctggccagaatgcagagaaaagggaactcttctacactgtgagtgggaatgtaaattagtacagccactatagaaaacagtagagatttctcaaaaaactaaaaataagactcaatataatccagatatctcactactgggtatttatctaatgaaaaagaaatcagtatatcaaaaagatacttgcacccacatgtttaccgcagcactatttaccatagcaaagacatgaaatcaacctaaatgtccatccacagatgaaatggtaaacaaaatgtggtacatatacacaatggaatactatttggccataaaaataaggaaatcatgtcacttgcagcaacatggatggaaccggaggtcattatgtcaagtaaaataagccaagcacaaaggacaaataccacatgttctcactcctatgtgggagctaaaaatgttaatgtcatggagatagagagtggaatgatggttaccagaggctgagcagagagtgggagtggagaggaagagagtttggataatgggtacaaacatacagttagatagaaggaataagttctgatgttgtatagcagagtagctgactatacttaacaaaaatgtattgtatagttcaaatcagctagaaaagaggacttgcaatgttcctgacacatagaaatgagaaatacccaaggtgacagacaccccaaaaccctgacttgatcattacacattctatgcatgtaacaaactatcacatgtaccccataactatgtgtgtgtgtgtatctatctatctatctatctatctatctatctatctatctatctatctatctatttatagtatccatttttaaaaggcaaatcttaaaaaaaagagtgaggtaggacaacctgctctactaaacatttttataaaggcacagcaattaggtcagaatagtgttcatgcaggtagaaacaaatcagacaatggaaaagaaaggaaagttcagaaacagattcacacatatatggacacacttgatttttgacgaaggtggcagttgatttttttttacaaaggggcagagtagttaaaaaagggagaaactgttggtaaatgatgctggaaaatgagaaatccacatgagaaacagaaacttgagaagtaactcataacatcacaaaaattgatgtcagataaactataaatctaaatatgacaagcaaaaactatgaagtttctggaacataatatagaaaactatattcctgacttgggaagggaaagattttaaaaacaaggcacagaaacactaagagtaaaggaaagactaataaattgaactgcattaaaataagaaaaaaattaggaacttaaattttcatcaaaagacactattaagagaatcaaaaggcaatgcatggagtggaagatgatatctttaacacatctaatctactattcatatccagaatatgtaaagaacccccatcaatcaataagaatacacacaagtcagaatacacacaaggaaaaacagggaagaaactgcacaggcagtcataaaagaggatatccaactgctcattaaaaggtcttctacttcattagtaaagcaggaagtacaaattaaaacctgaatgaaataacaccacagatacatcagaatgtctaaaacaaagactaacaatgttggtgaagatgtggagcaataagaactctcacacacagctggagtttaaaaaacatccttatttatccatcagggctgtaataagaggcatatagcatattcaaataggtaagtgaacaaaatttaatgaaagaatttacaacggtaaaggtagaatttagtaaaaaccaaagggtgaggaagtcccccaggctagcaagaacaggaagccattactaccctcaggcctacaagggcaagggaggtagcagtcacgcagcaccggtagctgtgaacacaggagaggataaacaataggagctgtggccttccatggagggaaaaagtcactgccaacccatgaccaaagagagaaagctggagaaaaaaactccccaagctctctcctcctactctcaggcttccttgtggtgactctcatttgcttaacccaacagaagatagaggacaaaggagcccatttgatgtagtcgacagaagtcaaactcccaggacaagaggagcagagaaggatggagaatgaattagagaagtaaacaaagaaagtcggcacatctactgtcatcaaagactgtgtaattccactatttaatacatgtacaatagagatgtgtgtatatgtgcaccagaagtcacctacaagaatgtccactgcagtattattctctcagttaaatgctatatctggctgcacaactagattaggactgagaccctaaccacacatgtagaagcagggagaaagatgcagttgagaagccctttgccatctgatatgcttccaaacaagggaaactcagcttggacactgaaagcattttgtataaaatactgtttgtatgatatccccatgtcaccacacacacacacatacagacacacacacatacacacacacacaacaaaaacaaaaaaaacttccagggttacttttctcctcagttagcaggtcaaaacttttcacgtgtgaaatacttttgcaaggaggcagatgaaacgggggagaagggataaccttgccttgcagtcatctatcaattcactgcaaggaaggaacacagagcttagatatgaagcatcaggagttcttcccaagacccttcttgtcccttgggaagagccaggagctggaggggatggccttcactgagaagtggcatcaaattagaacctgcacaacaaataggaaccagctacttaaagatccagagaagtagccctctagactgaaggatcagctcctcaaatatcctttttgattttgaactcacaagttcaggggcatccgaggaacagacacaagccagggctgaacaatctcatctgtgtccatgaggtgggcaagagccagatcctactgaggagtttgaacttaatcccaaacatggcgggaagccattggggccaaagatgaattagggattgtctgatctccttgacacgttctgaaggttttgtgtacagaaaaggtttgtcaacatgcacaaaggaaagctgggataaccaagctaagacgctaccgcatcattctaggggacgggtgactcattccaggagtttctgcaggaagacctatcaggactggtgattgactggaggcagagagcacgaaaaaagaacaatcagagatgatctgtggtttgtggttgttgtgtaatgttaaggcttaacaactgcgaaaatagtgtttttactttacagagaagaagacttgaagaatacaagattggggagagcagatcgggatttgtactttatatcagacgtgctcatagatatacatgttgagatatcagttgggagctggatatatcaggattcgagactgggaatcaccagtttatagatggtttttaagccatgtgattggatctcatttcttagtggggagaagtgagataacaaataaaagccaagattaaagctgaaccttcagcctgcccatcacttagaagcccagcagggacagaagagccagccgacagcacagagtcgaggaggaggatttccgggcttcagtgagtgtgcatcagagattcatggacacaacttaaagtaagaccagccacacagttcccttcattttctcaagcaacattcagcatctcaaagtgcggctactacacacggagccaagccctggtccagttatcacaaaaccttactagatatgtcgattattagctgcattttatagctaaaggtaggcaggcacagagaagttacgtctcttgcccacagtcacagcaagcaaacagacctcagaccaaagtctttctaactccttatttcacatctaaaacactatgtgacgccacctccaaaaaatgtgggggttactctaggacaaaagaagctcatgaaagcaaagagagaagcatagagcttaaatttagaacaatattcagggtgattgggaaaaatagcctccatacaaatataatcggttcatcaccaggtgaataaaatgagagaggaacctggtacaagtgaagttcattgaatttgcttgcaaaaaaacataattcaagtgtggaagtttggaaactaaaatagtaatcagctaaagaaattttcaggccaacttagacacaatggtgacaaagctcccctgaggagacaggaactatactacttgcaactctaactgaatggacttaacttagcaattaagatcaccgtaagtttgatcagataagtattaaagggtgtcttgggtacatttgcagattcagacactcttagttgtgaaattcttcaccaaaaatttgcaacttatggcttgcacattaaaaacatgatatgaatgaaattcagatatctcttggtaaattttataattattcctcccatcagctaaagttctcagtatgaagggttataactgatgtcatatacaataactacaagctgtatcatacaaaaattgagaattttctattatagaaagagttgctttaatctaaacctaaagtagcatcaataatttttcgtaagtggtccccttcctatgagtaagcccccaggaaaaataaattgcttttaagaaatgctgtaagtaagctgtttcatatataagttttgacaagatctggctacttaaattacaagatataaaatgagatttgtactttttctcaaatgtaaaaaaaaagatttacttctgaaataatggtctttataaaatatgcatttttgttcctttttcttatcatatctataaatttactaataaaagattctatcttgatttactaacatttgaaaagattgattatattggtattgcaagaagaggataccataaattaaaaatccatatattaaccatattcttttatttgcaatatgacaaatgattgtgtaaagttataatcaataaaagctatttgaaagtcataaaatggatattgccataactgctttcctagcaaggttaaaacactttaactatttttaatcaacttacagtgtagtagatcaagcatatctaaatattttattttaatcaagcaaatatatttctgctgttcctatgacagtatgaaagtttggttcaaaatatttccaaggtatttaacacagttcagtagaggtcctgtctcataaatcaatttcagattagataaaaggaaaaagcaaattcttgtttacttcagaatttttcaagccagttccaaagacagagttgttactctcatgtgaattttcagtagaaagctgaacaacgacgttgctctgacaatctttttaaataccatatgatggagacagaataacaaaaacaaagtaggtataagctgtacgaaattatttctcttggacataaaatatgtttggggaagaaatgcattgttccatatggactagggtagttacttctcaaagtgggagcaactcagactctgaaaaatggtttctcaaaggaggcattgtgtctgggtgaggccagttttctagtcaaaatcattttattaaatgccattggattgaatgcttccaggtttgctctctgaaatatgccctatcattcttaaaaaacacacttaggtagcaaaaagggcacactaaaaataacgtgggttaatgtttctatcctgcctgtgttttctaagtagcccctgcctgagctttcgacttttttaaatgaaccatcaaatagttggttgtctatcacaaataagccatctattttgttattcctgtaactttttgtagaatccagaaagtaacattcttgctgatatatcttatataacaccaagtccattttccaaatgaggattccaatgagtattcatcaccaacatctccccgaaaaatatttagaaaaaacagactcaatcctttatccaaagtcagtgagtaagaggcgggggccagggttggacaaaaatctctttggccaggaagccggtggtcaccctgatctacttctctaagctcccacccctgatgaatgttcaatatctgagtttcaccccactcattattgtaattctccgtaaaaccccagttacccacacggaattctcatctacatctagcccaatttgctactggatttcaatgttatttcatatgaaaacaatcactaacagaaagaacctggatctggtttcgaaaacataatttgaaaggaattcattctgaaggctgcaaaagcccagtgatggcccatcggtaccctgaatgggcttctcaggtgcctccactctcctccgtatgtctccatccatctcagaatacatgtctggctcttcctgctcataaacagaaacagagagttccgggatccaaaggcaagactgcgatttaagagacactttgtttttgtaggtgttcaaggatttggaatcaaagcagcagaattattaaaattaatccaattttcttgcatttattttgttagttcatacctctaaaagatatattttggaaggcacccttcaacccacccatttacaaatcaaagctttctttggaatccctgagaccaaacccaagctagacagtgacacactgccagctccagagccctgcccacctggaaggggtatggaatgcactatttgacttgagctcacatttaattacagtgtcaaaaatcaaacttaaattgctttaatcagctgccaacactatgagcctttctggcttgaatttctataaacaaagaataaattcaaatctgtcacaaagtggcagcaacttgttgaccactggactaggaatcgttatgcaaccatggctcactgtggaaaaagtcaacatcttcctatatgtgactcttttctgatcttttcggactattagtcaacagaatcatcataaagctaaattatctatctgcactgaaattactcagcctcagacatccaaaccagtagctgttcaccaatgaaacctgaataaagctgttgctgactttccctgcttcaatttagagtatttttggaaacatcattgcatgtttaaaatataataagcaaaaggacctttggtaattaaacattctgtaatttaaaactccaagagacaggagcagtgataagatattagattttctttactggggtgaaaaagacagaaagtggttaactgtttaaaaaaagaaagaaagaaagaaatccaaggatttttagagccagaaacagtaacagtgtcctttattctggaaatgtttaaaagcctgtaagcagagatcacccagttcatcctgagcattggtgagcaaataacttctgaaatgctcttgaaagagaattctccagccttctctgtttgaaatacttcctaaagcaaacacaaaagtgggcaaaacacaagagctcatgttaattccaaacaaagagaccaacagtcgcaaattgagagtccatcttagaagcgggtgctgcttccacatcaagcaactattggaaagagtaggggtagatgcagaattaagatcatttgtgactacagaaagagacaagaaaattaatttttaaaactaaaagagaaatttatttcagataatccaaggaaatgagcagagtcaacctaacaggattctcaagcccctccctactggtgtggtgtgaagatcacacgtggtgtagctgacacccctcacatcttccccgcgcccctcctgccacctctttttggcattcaccctctctcgggttctgtatccctgcccatgttctccatgaaaggccatgttaatgcccatgctctttcctgcctctaacagacgatgccttccacagtcactcaagctttaaccctcttctggattcggacctgtacatccaaaagcctgccagacatctcttccagatgctctcagagcacatgaccagaagcacgcgcaaagctctcctgagcctcagtgctttccctccaacacttcttccactctctcagttaccgagccaagacacagagttgcttgtgagtcatttctctacctcatcccccacccaaccttcctgcgagatcctgctcacgttacctcctaaatgctgttacgtgacttcaaccacgtcagctttttatgggggaggagaggcacctgcatatctgtgggagcaccaacctctagacatctcctgccaagttactgcaatgtgcagaaaagaggaagaaagcaagcccaagtcgcaaagtctttgccagtccttctaccaaccacaccttcggtggagatgtgggtctgtggaaatgcagagacggactgaaagccaaatgggccaatgagagctctgaacaaaacattaagcttgtttttctttaaggcaatacgattaacagtggtccattaagaatccgtttaaaaaaaataataataatactttttctgactattgttggggaagaataactcctttatggggagtatgaactcaaagacatgatattgtaaaggaggccttgaagaagagagggactaagaaatgtgatggcgtggtctgttacatgtgcaggtgctgtgtgtgagggaagcactgaggaccactggaggatgagggatgctctgtccttctcgggtatggctgaaggacagggattgcccatcaaggagtaaataatccatgagtggactaaattctttagaaacaggaactcaaatccagtagggattaggataaaaatgtaaactctaatttgcacctctccctctctcccctaagtagtccgtttctataattttatactaaatcaattaaatgtatctgctataatattaatcataattttgtctgaagtagtaacaactggaaactacctaaaagagtcagagcaggactgtaagactatattgtagtctacactatgtcacagcggactgcatcatgatagagaacgatactcatgatttaactgataaacacatatggcaatgaataaaactgtgagtaagatgtctttaattttagcaaaattatcttcattctaattttcaagtaaacttaaagatttatatataaatgcacataatttaattaaaatacatgcatatattaactagaaggctaatcccccaaaatgtccatagatgttatttctgagtgaggagggtcaggaaggttttaattttctttgtactaactctatttactaaaatgtccacctggattaacgttataataaaaatgttaccgtttaaaataaaatgaataaaatacaccggtatgaaggtattattagaacatacgaaagtacaaaatcaagcagcaaaaggaggaaattatattaagaactgaaaaaactatgttgagaattctgtctaagaaacgctgtagcaattaagaaaaatcccagttctgcaagtaatgggagaaagatgatgacttccagaactttcaccatctactaagatgttcaccaattcctaagaagggactgaatacgtctgcatcctcagatctgagagtaattttccacgacgcatactgagcaccataatgagtgaagtctctgagatgacctctctgacctctctaaaacaatcaggcactgcaaacatggcctatcccacactagcccttggtgaaattcaagggcataatattagactgaaacagtgagaagaagattcgacatggagtgcggcaagaatgtgttctagtccttgaaggccagcgctattccaagtgtggtctcagaccagcagcctcagctgcagctgggggcttggaaatggaaacgtatgtgctacgtcctggacctgtggaatcagaatctctgaggtggaccaggaatctgtgtttttaaaaccctgtggttggtaacttcctgctggctgaggacagagagaatgcttagtgaacgctgaggaatgacgggttaaataatccctgaatgattcctgagcggatcaatttctcagccagagttttgaccgcagctgatgatgaacagggctgtgaccaccaggaagggtctgaagaggaggcgttgattgcagttttctgcctctgatcctcaggcatggagccccaccccccaactctcttacacggaggccaaagaaaaagctggaattctccaggagagcaggacctgttaaacagcaaagggcaacccaaaattgtatgagtggccttgccctgagaagctttgaagccagaggttactgaacaactaccctggttaaaaccctaacgtgacaatgataacatgtgactgtatgtggctgtcttcaaaacagcaatgatttaggcacaactgtggatctcagattgttccgtgagtttggtctgataagattgtatgcgtttcccaggggtgccataacaaagtgccacaccctgggcggcttccgccaccgaaatgtattttctcacagctctgaggtcgaaagtccaagatcaaggtgtcagcagggctggttccttttgaggctgtgagggaggatctgttctaggctctctctcccccagcttctgggggctgctgcagtctttggtgttccttggcttatagaagcatcatcccaatctctgcttttgcgttcacatggccttctcctcatatacctgtctgtctccaaatttcctcttctcataaggacaccaagcactggattaggggcccaccctactacatctgcaataaccctatttccaaataaggtcacattttgagggaccagctaaatacaaaacattagccaggcatggtggtgggcacctgtagttccagctactcaggagaatcacttgaacctggattagaacttcacaattactgacacgattcaacccatattaggttgtttagtattatacattaggaagccatagcaaacttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcacccgccactacgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcccatagcaaacttttgtaaacataactatttattaaaatttggtataattaatatttaaatatcctttctggcaagatttagccagttttttaagcttcattgagagaaccacaatattagcattaataatagaatggtctattaattttttaaaaagatactatgtctgcatttccaatataaaattcacagcaatgattcaggtagaaattaaatgaggatgtcattgtcaaccttttaaattatattacaggagcagggagcacacgggccctgaggtagaaatgaataaggaatattctagaaccaccaagaagccagtgtggccacagcagagtgagccagtggtgctggaggcaggtgagatcttgaagggccttggcaacatgaacaggagcttggattttatccacattgccgagggaagtatgaggtggtgtttagcagggcataaatctcatctgatctgtactttgaggaaaacactctgacttctgtgtggagaacagtctataggaagccaagaggagaggcagggagatgagggaggggtgacttcagtctccaggagaatgagctagtgatgtgaattaaggtgctggtggtggaggaagtgaggtggagaactggacactgggatctattttgaagagggagcctacagaacttgttggtggatggctatgagggaaagaggattaaagaatgatgctaggcatttgggcttaaacaaacccctgagtaaatggttatcctattattaatactaagatgggtaatgctagggaaggagtagccttggggagcagtgatgagttattttcttagagagaagccacgttacctataggaggctcaacagagtatcaaattagaataaaatatctaatgttctgatttgtgtctttattttttccattaagatacacatggctggccaggcgcggtggctcatgcctgtaatcccagcactttgggaggctgaggcaggccgatcacctgaggtcaggagtttgagaccagcctggccaacgtggtgttaccccgtctgtattaaaaatacaaaatattagccaggcatggtggtgggcacctgtagttccagctactcaggaggctgaggtaggagaatcacttgaacccaggaggcagaagttgcagtgaaccgagatcacgccattgcactccagcctgggtgacaagagcgaaactccgtctcaaaaataaaaataaacaaaaaccatgggaaagaacaattgaggaaactggggacttgtcctggaacagaagacacgaggacttttggttttttagttttgtttttgtttttgagacagagtcttgctctgttgcctgagctggagtgcaatggtgcgaactcagctcactgcaacctccgcctcctgtattcaagtgattctcccacctttgcctcctgagtagctgagactataggcgcacaccaccatgcccagctaatttttgcatttttagtagagagagggtttcatcgtgttggccaggctgtcctcaaactcctgacctcaagtgatccacccgcctcggcctcccaaagtgccgggattgcagaagtgagccactgcgtccagcaagaatgaggtttgaagggaggcatgattgtgttctcttcaaatagttgaaaggttccatttgaaaaagggatttacttattcctatggttctagtaagttgcagagggtggatctaagaccattgggtgaactttacagagaggccagaaagccttctccaggggaagaaagtcaagaaaaggtctcaaaactgtctggcagaattctgcacaggagagtcctcaattcggtgtagaattggcaagtataataactgtaaatccctctcaatctaccatctacatcattaggcgacatcttcatttcctgaaaattccaacacatgaaggctcacttactatcaagatgagcaagtttgtgctacatagtgaatttgatttcaataggactcattttataccttttaagagtctttaaaacgttgaaaatgtaaagatctgcaagagcaactgatcttcaaagtcccgtcgagtcacaggattttgtaatgatgtctaaagaggaaaattcccatttcagaaaaggctcaatagtatttaatagttagctcaaaaggacgaataaagttctacatgggaagctgctgaactacagtcaggccaaaccttcatactcggagaagatgactgggcctgtagacacagatattgatgataaatcatcacaaaccacagctttccttaattggggtggtgggcagggagagcaggcttcaggttggccttcctccagcaagggcacacacacaaaggggacctgaacacgtggagcttatggtcaggaagcctgaagtgcctgacccagcacatctggtgactagtagtgtagattccccacagaaggaatgacaaggcgtcattattcaaagtgaccttccctccattggaataatcagaaacagctcacaaataaagtaatctgtaagatgcttcatcttctctaggtaacctctccccaacatgatgacatcacttcacatgaggcgacatggttttgtgaggacttttctttccttccaagtttggaatctggctgaaggctaaaatcaccatttacagtgtttgagccctccttcacactttgaagaagggtctgtgtaaatagccattcctacttctcagactcgccagaggcaaaacctgttttgctttggtagtacacgctcttccttaactggtaaaagactttaaaaaaaaataagatgccatttttaattgtttcataaatctggcttagatatattaaggaaattgctattttatatgtagaacagcggcaagcaaatctcaagagattaaaaatcatgttcttgtggttttcttttagaagctgcaaatttgaattcaatttaaaaaatcatggcacagggacaaaataagaatgaacaaagatgggaaaaatgtccgcagcattctgcagagtcaagcgctgctgtgagtgagtgtgcatgtttccaattacacatcagggcttggcgagctccaggagtcaaattcagacagaacccaagtgcagtgcgttacacagaacccaggccaggaaaagcttcacagagtctttctttcaactgaggcaattgtgtagacaatttggttcatttcaagaaaaaaataaaactgacagaagaaagaaaaatattattatattttgcctctcaaaacaaagtcaaattgtgttggtgtataaatcaagattcagtatttccttggctgcttccagaataatagtagatcacaaagagaataagaacaagaaagttcagttctcagccagacgatccaaggtaacaaagggtgagaccctcattccgttactcacaggagcaaacagacaaccaataataattgggcacatgggggtttcaacaagataaactgttatgtgagtccagggtgctaatttctggattcttttgagttgcaaggaaaatatataccgattccccacccccacccacccacataacaagacacaatagttaacagctggaagactgtggttagggggaaatgtgattgtaggcttccatttcaaatgatggaaaatcatttctgaagtcactacgaaagttacttcacaaaactaaaagaagccttgacaccttgtgttatcccatcatctaaagcaattctagtttggaaacacttgattcttggcaggggattctaaagaaggtgccgtatgtgaaaggctggtgtgtcagaaggagctttaaggaactggaatgagaacagccaaaagctaagatttctgattataatcacaggtctggatgtgttcaaggtaaaaagagatcatccccatcatttgcaatattttcaagagaatggggctttagtgacactgatcaaagtctgacatggattttcagctgccttccaactccacatacctgcaattcaatgatctctatggatagtagaagtaactgccaccctgatgttctcatcggtgatttatacgtgaagtggactcaaaagaaatacaacgaaatcccttaataaaaattatgtccattgacccaacaagcttcccagtgctgtatcagttctcaaccgattttagagacatttggtcaaaaatgatctacttgtaataagccatctgagggcactagctctttttcacctctgtgttccttgaagcaggaagtcagtaaaatcactattgaattaaaatgaagtaaagcactttgagatttcagatttctaaattaaggaacacacaacatacggtactttatttgcacaagaattattagaacccagggctaacacccaaatgaggtcacaggtaaatgaaaatctgtctcagttatttgaactcaggtcaacacacagacagagcaaagcaccagctgacctctgatgcacaacccagtgttcttaccatagaattccagaaggcatctcagtcattctcttatgtaaatacaaagacgacaactggtttaaaaattcatttatttttattttagcttctttgtgtcaaactcaaagaagcctcacataaatgatcaaagactttttggtggatcttccaaacgtacatgccgggaaggcctgcttgcactttttccttcaatcctctaaaatgaaggttttgaagatgcttgccaatggaacgttgtgccttacagctataatattttttaaaaggcattcagtttaaattaatatatttggccagacaactgtattaaaattcttgttgttttttctgttataatggtagcctgtggtatgactagtcttcttcaaaaatatgtacagttattgcttctctcttgcctggggtatatcatgtgtttttcatttgagtgtacattgcaatacctcattaaaaccaacacttaggctacacaaaagtcttcatatcatgccgcaaagggcgtaaactaacgtggaaagtttcagagcctcataactcattgcatatacctcttatactagctgctcaactgatatttagctctcctggatgatgtcacagtttttatcctcttaaaatagcctgccttcagaaaatatatagtttccttcatgcactaatcatggggagttacgatgtaaatagagccattttttttcttatacaaggaacaagtgctctcaccctcctcccttctctccctccccatacacagaagcacacttcacttcacttatactaaacacttcacttatacttacactgcaacaaagagttgcaaatacatgcaaataaagcctttataactcccctctctcctgctggacagctccttgactcaagtatttccgaagacagacactctgataagggtctgctctgagcttcattctcagcatacagtcctgggattatttacctaccaatattcacctctgcatgaaccagtaagtcattactgacaagaaaaaaacaatttgtgattttttttaatgtcacaatttttctttttaaggtttgggagagaaagttgttttgaatgtttcatcagtttctattgccaaatgaacacctgtttcagagtccctgaaagtcacacatcagaagcttctgacttcaacatatagtctgctttgaagaattattttaaaaaagcattgactgcttgaagataagcaagtgacactcaatagcttcattctttagtcttagaaaataatttttacacttcacacctattaggatggctactatgaaatataaaaaaaattaaaaataacaatggtggcaaaaatatgaagaaattagaacccttgtgcactgctggtgggaatatcaaatgatacagcctctatggaaaacagtatggtggctcctcaaaaaattaaaaatagaattaccatatgatccagcaattctacttctgggtatatattcaaaaaaatttaaagcaggatctcaaagagttctttgtacagccatgttcatggcagcattactcacaatagccaaaaggtcaaagcaacccaatcgtccatccacagatgaatgaataaacaaaatgtggcatacaataaaatgtcattcagtctttaaaaagaagaaaatttggacacattgtacaatatagatgaatctttttttaaattaaagtggtttttttaatcgttttattttaaagttccgagggacatgtgcaggatgtgcaggtgtgttacataggtaaacgtgtgccatggtggtttgctgcacctatcaacccatcacctaggtattaagcccagtatgtattagctattttccctaaggctctcccacccccaccatcccccaacatacaccatagatgaatcttaaggacattatgctgcgtgaaataaaccagtcacaaaaagacaaacagtgtatgattctacttatgtgaggtacctagagtagtccaagttcagaaagtagtaataatggttgccaaaaggtgggagcatgcagaacacggggagtgttgattgacatcaagtttctgttttgcaaggtaaagaagttccagagatttgctgcaccaacaatgtgaatatacttaacactactgaactgtaaagtggttgtgactacagattttatgttttatgtgtttgccacaaccaaaaataaagattaaattaaaaaataaaagattttatagcacctatcacttaccaaacccactgtacatcttacactcgtgaatattttatgattttcaaaacacctttatttttttcccttatttgttcattccttcatgtataacccacaatgtgttaggttatgtgctgggcagcctggaagacccaaagacgaattagggaagtaccctatatttaaagccttgcaaggacataaatatcagtaatataaagtaaaatatgttcactgctgaaaactgctatacttcctagatttttcaattcaattgcaatttctaatattttgccatgttgatcccacaaattcacttgtgtttaaaagttaacgtgcttgattatcatacagctgcttctttcataagaggaatacagataaaacgctatgggatttcagggggagaaagaacttcttattaaattcatattttcaaccaataagaaaacacaattttttttaatcaacactatcttcttggtgcttttttcacatctcatcctctttcctcctttaccctgcctaagcaaccatttctggacccaatcttgggttattacatctgacggcaagtgttatgtgggccatggaccatgagcaattagccccctctctactcctagggatggagtacatgtgatgatttccatcagactcagattaaatatcttgctggtaagttacccctaaaaatcgattaatggactctccaggtagacactgaggtaatctccaaccaaacctgacttatacttaggggctttggaagcccaccagagtcatcaagccatatctccacctaggctctatactggaaagctggtcagtagtaacacaaagaacaagccatttgggaaaacagcccacatgaaaagaactgtggtttcaagaagagtcattccatcccaggtttaaaatactcttctcctctttatctaccttgaggactcctatctatccttccataccagatccagcctcatcttctaagtgaagccctcctctgggacgtcagcgtctcctctgcatcccctagcattttatgcatcctctgttaaagcaactgtttgcacagctgtatccaccactaaacttagaggcaacagaccatggttttgaatgtgtagaacccaacacagagcccgagacctagtgggtattcagtgcatgttgaagggaagaatgaatgcatgagcaaacaagacaatggaagtctgtcatcagtatttacatttcaaaatgcaaagtgaaaattgtgcaaatctctaatcaagctgtactttaaaatgctaaattgatttggctaaaaatatttcaacactgaaatttctttttgcaagttaagtcttcgcataaccaaaacagaaaagaacgtatcaatgaactaaatagataaatttatggctgacaaaatctcaagatttagtgtgtgagaggaaagtaaaattcaatgtgtccttgaaagttctggggtctaagatatacaggccaatggaatagaatagagacttcagaaataaactattgcatatatggtctgataacttttgaaagtggttcaaagatcatttaatgagaaaaaaaggagtcttttcaacaactggtgttgggaaaactgggtatacatatgcaaaagaaaaaagttgggctcttaccttatactatatacaaaaattaactcaaaatagaacaaagaccaaaaaataaaagctaaaactctaaaattcttatgagaaaactctaaaatgcttagggaataacttcataacactggatttcacaagcctgtcttgaatatgacaccaaaagcacaggcaacataaataaaagagacaaatttgcctgcactaaaattaaacacttttgtgagtcaaacaagctatcaacaaagtcaaaagacatcctataaaataagagaaaatatctgaaaataatttatctaataagggattaatatccagaaaaaaaaatatatatatatatgtatataacctacaactcaacaacaacaacaaaaacaacccaatttaaaaatgggcaaaggacttgaacagaattttttccaaagataacactaatggccaataagtacatgaaattatgctcaacatcactaatcattgggaaaatgcaactcaaatccacaatgaaatacttcgtagccattagtatgactattaccaaaaaatcagaaaattacaagtgctggtggagatatggaaaagttgcaaatcttatgcactggtggtgggagagtaaaatgggaaagtcactataaaaaacagtctagtgattcaaaaattaaaaatagaattaacatatgattcaccaattccgcatgaagatagcaggaaattgaactgatatttgcacatccatgttcatagcagcattatttacaataaccaaaaggtggaggcaacccaagtgtccatccacagatgagtggataaacaaaatgtgatatacacatatcatgggatatcttcagccttagaaaaggagagaaattctgacatatgctataacacagatggacctttggaaagttaagagattgtcttatttatcttacgctaagagaaataagccatccacaaaaggacaaatgctgtacgattccacttgtgtgagttacctagggcagtcaaattcacagaaacagaaagtaaaatgatggtttccaggggctgagagaagggtagaatggaaagctattgtttaatgggttggagtgtcagtgtaagaaaatgaaaaaagttctggagatggatgatggtgagttttgcaccacaatgtgaatgtatttaataccactcaactgtacactaaaaaatggttaggatgataaattttatgtatattttactataacaaaaagtcataaaaatcaaacatggttcttctcattaaaaaaaaaagaagattcctgggtctagttggttctccctccttcttagttcttggatcaaggagatagaattgtgtccaaagtgaccaagtgacctacggagtaatgggcttccatctagccactccctgctttatgactgagctgcactgggagaggcattgtcaggggaaattccaggtttctagaattggtatctagccagaatttgtcccagggctaagtggctaaggcagtgaactagtctgtcagcttctctgttttaaatggagtcatgtaattccattacataccctttgctttcaactatatggccaaacatgactggccagcaggctgggggacagaagacatgtgggcttgtgcttgttacctggaattgaaaagagctcttggcatggttcttgttcaagctccatggttgactagcacatgaccaccaagagagctactgtacttctccgagactcattttctcttctgtaaaaaatgactgagtttctttcacagtgcataaatcttttcctccaggaacagagactgcccagggcctgtccaagacaactaggaaaccagagcagcagttaagccattcctgggcaggaataaatgagcagatgtcagctctcagaatctcagttttctcactcataaaatggaaaagaatactatttcttttatgtcattcaccatattgtgagctgaaggcactttaacgatgctgaggctgtaaactaatgcataatgtgatgtttatcattcttcacctatgttttagttactgagcatctcctgacaccagagaggacgcaacaaaaatcacaactcctagaactgcacagtctaaatggcaaccactagcccctgtgacaactgatcacttgaaaagtgagtagtccaaattaagatgtgctgtaggtgcaaaatatatgctggatttggaagatgttctatgaaaaaagtatctcattagtcatttttatattgattacatattaaaaagattccattttggctatgctggactcttcagatatatcctgggagattgtattaaaagaaaatacatgatggaaattagtgtaggtagttactagaaaatgtaaaattacatgattcacatcctatgttcactgttctagacatataaatataactttgagttatttttaagcatgagaagacagaaatcgacgaataaagtgaaaaagctaaagattaaagatacttacaaatcattgttgtattttttaagaggtcattttgagcatattccttaccattgaagcccctgcctgtctggctcctctgcccaccttgttttgctaatgggtcatgctcctatatgtgcatagacgaggagcggctctcagggactgaccgtaagcatagtcagcacagcacgtatacccatgctctgaccccaggttggcgtcttggagggtgaagcattttcccagtccttctttgactcatcacagaggtataaaacagcgtctccaacacgtgatttttttttttttttttttttgagacagagtcttgctctgtcgcccaggctggagtacagtggcacgatcttggctcactgcaacctccaactcccaggttcaatcaattctcctacctcagcctcccaagtagctgaaattacaggcacacaccaccacgcctggctaatttttgtattttagtagatacggggtttcacaatgttggccaggctggtctcaaactcccgacctcaagtgatccacccatcttggcctcccaaagtgctgggattacaggctgagccactgtgccagttaaaagaaaaaaaatattcaaacatatttggtttcttattgaggtgaagttcacataacatgaaactaacagttttaaagtgaacaattcagtagcatttaattaacaatgttgtccaaccaacacctctgtctagttccaaacatttttgtcaccccaaaaggaaaccacgtgctcagaaggcagtcactccacatcacccctcttcctagtcctatgctttgcacacaactgactcaccctgacagttataacctaaaagttaaataaaattattagtaaactgcaaacccctggcaagtgaattacttaatatctcttaaaatcctgacatcaaatgattcccctgtgaggccatgagatgataagaacatccacctccctctcttgctccagtggaatgaaaccccctcctcaaggagggttacactcaggcataggcccgatcactcatcatatattgacagatgtgcaggcctgagaccccgccttctggagctttctaatgctccttgtttctcaatccaatccttgctaggaattaggctcttctgctgaatgtaaaatttttccatctgcctccataaagtatgtgccacctgtcagctgactggtcaaccccaagctcaaagtatatggacattttgggggtgacaatggtgggcatacatctttagcaaagattaagaaggtaccagaggaggaccagcacaacccagcaatgcagcagaatccatcaggaaagctttggctctgggtggagctccttgctttagctctgcctttgagcgcttgggtggctggggaggcactggggtggaagggaaggaagcaggaattcgtgtgctgcaaatttcactacacttgaccacaacttggagtggaaagggcactgtggtacgtctatctggccttcctttacaagccttaaaatgctgtggaatccatctggatggaagacgccatccaattataaatccttaggatactttttattgccctttaagagttccgatgcttgctcttccatgcccatatgtttctgcttaagaggcttcattcaaatcaaattggaagagaagtccagattacccaactacaattacctgagcaaaaatcccctcaattatcttggtaatccagataaattcggagtacaaaggtgagttgcctggatagcactggctaagaactgctttgtctcccatttcaccttgcattattataatctacttgattacacttcatttataacaatagggagggcttgttttatgccacacattgccacttgctcaagtgtaaaataaaccttaaatgactgatgtactgctaaatttatctcaaaaaacaatcataacaggaatcttaaggcaataaagtcaaacaaatagaattttacagaatttaaaaattattttgtgagtgatttatgctaaaatacctcaaatttatttcaaaaacagtcttacttaaaactgacttaaaatatatgtaggataaataatttgtagtgaatttaacgaaacttcagcaattcaaatgaatgcacattattcttcttaaaaacagatatcctgaaaatatccatcaggataaatagctaatgcatgtgtggcctaatatctaggtgatgggttgataggtgcagggaaccaccatggcacatgtttacctgtgtaacaaacctgcacatccggcacatatatcctggaacgtaaaattaaattaaatttttaaaaagcagatatttggaaagtaccaatagcttcaaagtaaaaatactctacactgtttttgtttgtttgtttattttcgtttttgtttttcttttttgagatggagtctcgctctgttgcccaggctggagtgcagtggcgtgttctcagcttaccacaacctctgcctcctgggttcaagtgattctcctgacttggccgtgccaccatgcccagctaatttttttacatttttggtagagatgatggggtttcactgtgttggccaggctggtctcgaactcctgacctcgtgatccacccgcctcagcctcccaaagtgctgggattacaggcgtgagtcaccgcgcctggcctatgcactgttaattttatcacgacagttataaatccatcaagatgtcctgtgatttttcaacacaaattactcaaattatgaacttctctgtgtgtattttccactggcttgtttatgaatcctgctgatatgtctgctacaatttctccaaaggctaaaagatgtttacaggacaaatgacatcatgaccatgtcaggcttaaatgtgtttatatcagttgggtttagagggtcttcaaaacatggctttaaaatctcagttattatggagcttaatgtgttcctgatgtttctggagtaatgtatttctaaaaatagagaaatagattggttaaaagaaaatgaattgttggtctaatctgtcttatgcatggctaacgaaatgcattttcactctcttccgtgataatacgacacttaaaactgtgaggaccaatggggtgataagagacaaaataaacagtaaatagatactccatgtgagttactactctgtaatagatagaaaagatattttatagaaaagggaaaatacccacagacatataagcaatgtcctgtggttgctatcaaatttactgttagctgtttaaaactgccttaaaggttttttaaatgtgtcttttctaccatagattctttagacgacagccatcaagcagcaaatacctcgcaggaggccattgtgtttctatttgaacttctatggatgtcaagctctgttcttcaaaatttagccctacagatgggtggcccaccggagagaattaatctcactatgcagccaacactaccctttctggatctttccccagtagtgtggattctgctctagtccagaattatgcagaataagtatacttcatcttagacaccataattcttcaaatatctaaaatgtatattatgctctccaaatcctggtcatctccaggttaagtatctctcaaaaacagtccatcagataatatgattttaaatctttatccccttggtcatatacccacaatctcattctatttaccaatatccctactgatgcataaactacatatgtatatgtgtgtttttttttaaaaaaaaagcaattccactgtaattttagcagaggttatttccacatagagctatgtatatgtgtatatacacatatctttatattatatagttttctgtgctttcccagttatctacaatgggcatatatgacttttatagccaggtaattcaatattcattcattcagtgaacatcattgagcatccactatgggctgggaagtgaggatggagccacaaacaagcaaaataaaaacccctgctcttgtggagttcccttctcattggaagagacgtacagtaaagaaaaaaataaaagagtaaagttaatagcctgtgagaaggggatataaaagtgggaaggaagacagggtgatgtgtgagaaacactttttttttttttttttcagatgaagtctcactctgttgcccaggctggagggcagtggctcgatctcagctcactgcaacctccacctcctggtttcaagcagttctcctgcctcagcctcccaagtagctgggacttcaggcatgcaccaccatgcctagctaatttttatatttttagtagagacaggatttcaccatgttggccaggctggtcgtctcaaacttctgacctcaagtgatctgcctgccttgacctccgaaagtgctgggactacagcaatgagctgccaagcccggcctggggaacactattgaatagtgtggtcagggaaggctttactgtgaaggtgatgaagacccaaagaaagtgaggaactaagtcataaatgatgggtagaacattccggattgcgggagcagcaagtgcaaaggccctggggtgaggaataccaagaatgtttgtgtgggcagagcagaaagaaccaagggtaaagcattaggagatgaggctgaagaagtaaccgggatcaggtggttagggccctcaggccctggaggaaggctggcagcgctggagccacatggactgacaatgtctagcagtcatcccggctccctgtgaagaacagaccctcgcttgcagagaagcgaggacaattaggaaagcagagtcatgatccacgcacaggatcacggtgacttggaccagaaagagagcagtggagctggggagtgactcttttcagtatttctcaggtggtaccagtgggatctgcagagaatacatagttaaaggaaatgtctggaactaaacatgactcttcaaacgtgatcctactgtggcagaagagaggcgactttacatttcctttcccaggatatcttattctaatgaacacagaaaccgtaaaatcaagccaaccaacatgatgaaaatgattatataaggtacacagcccaggctggatttgaactgatgagggaaaaaaaatctctagtgaaaattcctctctctaaccacagccttctctccttccatctctgcctcacccttgctctttctgaagccttcctggatgctcatgaagctctctccttctttgactcatcctattttcccaggacctttatcaactcagggctcttctcccctccccacagtcagctcactgtgctctgactagttccctgaaattgctcatcctcttactaaccaggaagcttctacccgctcttggtcttctttctccaccccagtgccaaagaactaagcactgatggagaaaaagcatgcggctaatactgtctgtctctaccacaaatctcataatttttaaaatccatttggaatttacattcactccttaacttcttttcattcactcctaattcacttcctatataattctctacacagctgctgaaaaccttcctttctgctgcctcttaccccaaaactactctcacattactcacaaaggttgaccttgttttctatatacttttttagagtaacgaagccataaaatgtaagttctttcaacctggacctcccactcttgggatttctcaatagcttcacctgtattctcccccttcactcttgactcagaggtaaacgctcccttgctcccaaatcctttagcaacgtagggttgataattgctcctttccaaatttaatccctgcatctgcgcccctgagacagacactgccatgatttcccagcttgctgtcttctccctcctgcatctcctccctttctctgtgacggatattttccctgtgcaagagaaatttcttctgccctaaaataaataatccaaaacatctcttgactccacttaagctaacattcaatatctcactttcccttgtattaacaaaagttaattgagtcagtacggtgctacaattctcagacacaacgataaacatgatagagaccatcaacatgccttggcattttgcctgctttctcttcaattacttgcaacttggcttctactgagctccactgaaaaagctttcatgacatgaccacatccaatcccaaagaaactgtccccttgcccagtggtcttcaaaaccctccaactccacagtgtctcattaactccaactcatttcctactaaacatctcttctcagctcttcaaagtcaaagattgcgaaccaaatctacagacttctcctctcttctcctttgggtccaactccatccttctccatgaaacttcttattcctagaaatggtgtctgcaccttttaggcttccaggcttgagcctagagtcatctttaactctttccatacccagactcccaagacccagtcagctgtttaggtgtctcctctgtatgcagcacttactgtcattgccctggtccatctcccagagcccacatcttgtcccactgtctgcaaagcctttcctatatgctggatataagtgcaaactccccctaaaatcccattgaagtttttacttttttctatcttctttttttacttctttttatcttcctctactcacacagaagtgctccaattatgaggaccttattttattccctttactgtcaaacacaaagccaacatgccatacgaaaagatagtactgtgcttccttcagtgccactctagcacgcccactccagcacacccttcttgtgcgggtgtatgctcatgtgatactatcacaggcaacacttactatgcaatacgttttccacaatcacaatatttccacaatattgtgatatgagctcattcttcaggccttgacacaagcgcccacaaacctaagagaatgcattttcatttttatgatacacagttttcgactgctccactctggctgccaaggcattcctcctccaaatcacgatgtctatatcaaaagaagaacaatgagggagagctggaggtagcgctaagaaacaacctggtccagctcccaggtctcatagagaacactcagaacacgcttgttagaggtatctgctcctggcctcagcttctcagaagcaattacacatcttctgggtaaacgtggagtgtgcagcacagaataccaaagctgagcttcccattgtacctggttgttgatctcctcgttgacctccctcagctgaatatttcttaagaacagtgttcaattaatccaactatccctggtggctggcaggatgaatcagttatgacttatttcatgtttgtgggtgggtgtatgaagtggtcctcaaaggagatttttgctctctgcagacagtctgcctgtctgtaggtcacttcctgccatttcctttgagtgggaatatgagccagggtgttggaagaaggaagagtccaaaagatgtctcagggaatgtcccatagccattggcctggtctgccctagataacttctgagccaggtcaccctaaagtgctacatgaaaagtcatggattttttttctaacttgttgatctcaaatgtcgtgatttggcatgaatatctagcttcccatgttgcagctatggatttattcttgccaaaatattggggattgggctggagagggaagaaggtacgaagatgcattctgtgttgctcaacaagatctgcatggcctcaaccaatgcgtgtttgaccatatggatatttacaaaccccaccatcaactcaccaaaatgaagagtgtcttagacttattctcacaagacaagagggaacgctgcctctaaggagtctctctgggacacctgggagagatttatttaatggtaaagcaaggaaaggaaaagatgaacagtgacctgcaaatcattaaagagggcgactcgatcataggcaagggcttttattagtgctaaaattccacttcaaagtttgctgattcatggatgctttttgttttgctgtttatgttgtagaaactgatttgattttcatagacaaaataactaggcatttataaccacatataggtatgaaagaaagataaaatgatgcccttagcccagtcagaaatactcttaaccatcaaaatagttccctgaatctaataggccaacaatattccaacaccagaacctttgctaccatagccagaatttttaagactgcaccactgttaagtagaggcaatttttaatacttagggtctaaccacaaggcataaaatgcaaaaaaaattacataatcctgtactttttaataattaaatgaaaatacatagactctaagcaggaaaatatctgagatccttaaaacggtataatcataattgttctacattggtaatatgtgtgatgatatttttctccaaaaaaaattctctaccatttcattctctttaatttcttctagcccgtaaggtctagcaaagaggaatacctgaaaagatgcaaattgtacccctgtgctgttcaatgacagcaaaaattgcagctccccaaccccacctcttatgtcccctgagcaatctgtgatcacttgagggtgaggacagtatattgccccaataaactggctttccaccaagtaccaccaagaaatcaaaacagcttttattttattgtgtcatcatatataagttaatagttcataattagttcaaaatttaaaattatgttctaaaaataaagctttctaagtcaatgtaggcaacgattccaagatccttatagttttcctctcttaaacagagaccattatcatatgatttttttttttttttgagacggaagctcactctgttgcccaggctggagtgcagtggtgcgatctctgctcactgcaagctctgcctcctgggttcacgccattctcctgcctcagcctcccaagtagctgggactagaggcacccgccaccacgcccggctaatttttttttttttttttttttttgcatttttagtaaagaccacgtttgaccgtgttagccaggatggtctcgatctcctgacctcatgatctgccagccttaacctcccaaagtgctgagattacaggcgtgagccaccgtgcctggccagtcatatgatttctaaagagaaactgaacagttatttgtagaaactctgcaaagcatgactttgggacgggcacagtggctcacgcctgtaatcccagcactttgggaggctgaggcgggcagatcacgaggtcgggagatcgagaccatcctggctaacatggtgaaaccccgcctctactaaaaaaatacaaaaaaattagccaggcatggtggtgggcgcctgtagtcccagctacttgggaggctgaggcaggagaatggcgtgaacccaggaggcggagcttgcagtgagccaagatcgcaccaccgcactccagcctgggcaacagagcaagactctgtctcaaaaaacaaaacaaaacaacaaaacaaaacaaaacaaaaaagccatgcccaagcccacccctgaccagtgaaatctccgggattggggcacaggtataatgtttttataaacatcttcctagatgtttcctgcatccagggtgataaatcatcatactaaaggcatcatctgaaggctcctagagtatagagaagttcagaataaggaccccaaactattgcacatcctgacactaactagctgtagctgtgcaccctggacagggagagatctaaacagctagttatcttacttcaccgaaatctacaactaaagatgtctatccacgtgttatagctttggcttccctaatctagatgttcaatctacttttctgcaatttggcaaagtaaaacacacatatacagtaatgcacaatgtcctgattgttggggtttattatttgttttgcatttacgcttcttaggtatgtaacatgccaaagtcatgggagctgagtcttttgaaacagaggcttctttgggtgcaaatattaattttctatgaaaaaaagagaaagtacaaagaaaagaaaaaacagcagtaatacagaaatgaatatcttccttgtctaggacacagtgttttttttaacctagatttctttgaacacagactgacacaaaaattaaatactattgctccattggagaggtgcaaacctggggcggtgagagtgaggggaagcgagtgagattgtcactacactagcttctggggacatggagacagccagtcactgagcccctgccttcccttggccatgcagatgcctctgataggttacacggaaaaattctacctcacagcagcccatggggtggaggaaaaataggaacttagttgcctacattcttcctgcatccccttcctcattggtcagagtcaccctgcatgtctgggttgtcacctgctcccaaggtgaccactccaaaagtcaggttctacgcccggtggtggggtgcttcatccaagtacagaaatgccaagaggatccggaaaccttttgacctggttgctgagtcacaggaaagaagggccagccctcctgggacaggtaacaggctggccctgagctgtggaagccctcacacccagaaggagtcaatctgctggggtggccactgagaccaagcaggagctgagggtcctggagtaatagatggaggcccatgagatgtgttcagacacatagtgtgtttgtcaactgcaatgtgtgtgtgcccccaaaattcatgggtttaaatccttacccccaaggtagcagtatgaggaggaggggcctttggaaggtgactaggtcataaggatggaggtctcatgaattgcattagtacctttacaaaagggaccccagggagattccctcacccttttgtcacagtgtgaagacccagcaagaagatggacatctatgaatcaggaagagagccctcaccagaacccaaccctgctacactctgatctcagacttccagcctttagaactgtgagaaataagtttctgttgtttatatgccactcaatgtatagcactttgttacagcagcccaagctaagacagcctattatgtatgagcaggtggctttgagataattgagaaaacagagactataactacaaccagccagagatgggatcattgcaaatgggactcgggttcacacaaggtttgtgacacacacacaaaaaaacataaggcagataaatcagcaagggtagcagtcaggaattgacagacgattaatggattgaggaaacagaatagataatttaaaagcaaacctttgtacacaaaagaattcaggaggtgataaaagtaacattttcatatcagttggaaagtaagttattcaatagcaacagaacaatcatttattgaggaaaaataactatttctttcctggttcaatcttggggtgttgtatgtttccataaatttatccctttttttctgggttttctaatttttgtgcacagaaatgttttttaatagtctctgaggttttttttttatttctgtgggttcagtggtaatgtcccctttgtcatttctgattatgcttatttggatcttctctcttttttctttatcagtctagctagttgtctatcaatcttatttattctttcaaaaaaccaacttttatttttgttggtcttttgcatggtttttttgtatctcaatttcattcagttcagccccgattttggttatttcttttcttctgctagcagtaagtttggtttgctcttgttttttctagttcctccaggtgtgacattaggctgttaatttaagatctttccaactttttgatatcagtgtttagtgctataaactttcctgttaacattgctttaactgtatcccagagattctggtatggtgtatctttgttttcatttgtttcaaataatttattgatttctgtcttagtttcattgtttacccaaaagtcattcaggagcaggttgttcaatttccatgattttgagagatattcttagcattgattttatttttaccgtgctgtggtctgaaagtacggctagtatgatttcagggttttttttcatttgttgcaaattgttttatagccaagtgcgtagtcaattttgaagtatgtgccacgtgtaggtgaaaagaatgcatattgtgtcgttgttgggtgcagtgttctggagatgtctgttaggtccatttggtcaagtgtcaagtttaggtctcaaatatgttaagttagttttctgccttgatgatctatctaatactgtcagtgagatgttgaaatctcccactattattgtatggttatctaagtctctcactaggtccctaaaacttgatttatgaatctgagtgctccagcattgggtgcatacatatctagaacagttaagtcttcttgttgaattggaccctttatcattatataatgcccttctttgtcttttttgatcattgttggtttaaagtctgaaattgaaacgctgaacagaccaataacgaattacaaaattaaatcagtaatataaagactaccaaccagaaaaagccctagaccagagagattcacaaccaaattctaccagatgtataacaaagagctactaccaatcctactgaaactattacaaaagatttaggaggaaagactcctccttaacctcattttatgaggccagtatcattttgatacagaaacctggcagagacacaataagaaaagaaacttcaggccaatattcatgatgaacagggatttggaaatcctcaacaaaataccagtaaaccaaatccagtaccacatcaaaaagctaatccaccatgattaactacacattattcctgggatgcaaggttggctcaacatatgcagatcaataaatgtgattcatcccataaacagaactaaacacaaaaaccacatgatcatctcaatagctgcagaaaagacttccaataaaattcaacatcctttcatgtttaaaacactgacaaactaggcattgaaagaacatacctcaaaatactaacagccatctatgacaaacccacagcaacactgtactgaacaggaaaagctggaagcattccccatgagaattgaaacaagctaaggatgcccactctcaccactcttagtcaatatagtactggaagtcctagccagagcaatcaagcaagagaaaaaaaaaaaaaagaaacaaaatacatccaaatgggaagagaggaagtcaaactatctctcttcacagaggacgtgatttatgtctggaaaacctcattgtatctgtctaaaaactcctggatctgaaaaacaatttcacaacgttttaggatacaaaatcaatgtacaaaaatcagtagcatttctaaacatcaacaatgtccaagctgagagccatatcaagaatgcaattccattcaaaatagcaacaaaaaaaatacaatacttaagggtacagataactggggagtgaaaatctctatgacaagtattacaaaacaaagatcaaagaaatcagagatgacacaaagaaatggaaaaacattccatgcccatggataggaagaatcaatattgttaaaatggccatacttcccaaagcaacttatagattcaatgctatttctatcatattactaattacattttcacagaattagaaaaaactatttggaaattcatatggaaccacagaagagcctaaatagccaaagcaattctaggaaaccaaaaagctgaagtatcacactacctagcttcaaactatgccataaggccacagtaaccaagacagcatagaactagtacaaaaacagacacataaaccaatggactagattagagaacccagaagtaatgtcacacatctatagtcatctaatcttcaacaaagtagacaaaacaagcaatgtggaaaggattccctattcaataaatagtgcttggataactagctagccatatgcagaagattgaaactagactctttcattttaccatatacaaaaatcaactcaagatggattaaagacttaaatgtaaatcatacaactataaaaacctagaagaaaacctagaacataccattctggacataggccctggcaaagatttcatgacagactccaaaagcaatggcaacaaaaacagaaattgacaaatgggacctaattaaactaaagagcttctgcacagcaaaagaaactatcaatagagtatacagacaatgtacagaataggagaaaatatttgcaaattatgcatccaacaaaggtctaatatgcagaatctataaaaaaaaacttaagcaaattaacaagcaaaaaacaacttctttaaaaaaaatgggccaaaaaaacatgaaaagacacttctcaaaagaagacatgtgtgaccaacaagcatatgaaaaaacgctcaacatcactaatcactagagaaaagcaaaccaaaaccaccatgagatatcatgacacaccagtcagaacggcaattttaaaagtcaaaaaataacacatgttggtgaggctgcagagaaaaaggaacagttatatgctgcgtgtgtgaatgtaaattagttcagacactgtggaaagcagtttggagatttcccaaagaacttaaaatagaactaccattcaacccaataatcccatcactgggtatataaaggaatataaattgttctactgtaaagacacctgcattattcacagcattattcacaatagcaaagacatagaaccaatctagaagtccatcagtggtggactggataaagaaaaaaatgtggtacacaaacattacagaatactacacagccataaaatagaatgaaatcatgtcctttgcagtaacatgaatggagctggaggccattatcctaagggagttaacacaggagcggaaaaccaaataccacatgttttcacttataagtgggagctaaacactgagcacacatggacacaaagaatggaatgatagacaccaggggctgcttgagggtggagggtagacgaagggtgaagattgaaaaactaccaattgggcactatgcttattacatggtttatgaaataatctgcacaccaaactctcatggcatgcaatttacccacgtaacaaacgtacacgtgtacccccgaacctaaaataaaagttagaaaggaaaaaaaaaaaactaaatccctatctcacattatacatctaaaaaatccaaatagattagatttaattaaaaattaaaccataaaacacagaaagaaaatacagatgaatagttatataatttaggatgagaacagcctctgtcaggatgaactaaagaattcacaaaaaaaaatgttaacaaattaaatgacatgttaaaaatctggccaggggtagtggttcacacctgtaatcccagcactttgggatgctgaggcgggcggattacctgaggtcaggagtttgagaccagcctggccaacatagtgaaacctcgtctctactgaaagtacaaaaattatccaggcatggtggcacacgcctgtaatcccagctactcaggaggctgaggcaggagaattgcttgagcccgggagacggaggctgcagtgagctgagatcatgccactgcactccagcctggctgacagagggagactctgtctcaaaaaaaaaaaattaagaaactatatattgaaagactataaaaaatagttttggtttttttctcagtaaaaaaataatatatccattgtcaaaaattttctattttcaatattattatttaatagaaaaatttcaacaatttctggagaaaatatatgaaacacatttgacagagttttaacatccttaacataaaggatgtaacttatatgttacatccttaacataattttctttgttcagttaacaagtttttattgagtatctatattgaaatatgcactatgtctgacactggcaacacatttgaggaaataaagaagaaaaattcaagtccacatggaaaaatggactaaggacatgaaaaagtataaatcatcagtacacttctaataaagttaataatcaaagaaatgcaaataaatgtgacctatcaaggtcttgctatttgtactgtcaaattataaaaatacaataacaaatattggcagatattggggaaacaagtaatgtcatatactggtatgtgcttaaactggtaaaagtcttcagaaaggaaattggaaatatatgtaaaaattttggacagttgcatattctttgttctagaaattctacttatatgattagaacctaaggaagttatcatagatttaatcaaagatagttacaggatattcaacatagccctgtatataacagccaagaatctgaagccaacaaaaaatatttagcttaaaatgtatagaatatacataggatgaaattgcataggtcactaaacagtttctagggacatggaaaaaaaaatgccatattgcagaaatgcaatattttgggatgataaaagggcagtttcaaaaaattgaaaaaatagcagttactatgacctcttttggcaaaaataattatatgtaatattgttcatggaaaaatagactggaaatataacgattaaaatgttaattgtatctgggttggtgagattacatataattattatatataatctttacttttttagattgttgttcacagtgacatcaagatttgtcatgggagaaaaaatgaagaagattattattttgtagtcacccaaggagagaagaagtcacatctctggagataggaggagatagggcatatgagccaatcacatttctgcagccttttgtggatacaaaaggggtgggccaagcctttccaatatcccttttcctccttggtacccagacagactatatttaccagcctcctttgcagccaggtgtggtcatgtgactcattcctggtcaatgaaaggtagatggaagcctggcctaggaaacaggtctacatgcaatcttccattcttctcccacccactggctgaaaagaaaggcttctgaggacacagagtggggggaaggctaggtagaggctggatgggaagaaagcagggttctcttgctcctctcatcagagagctactgaggagacccaccgcacccagacccccatactggactgttacaggagtgagaaataaactttgtttagaccactgaaatttgagagttagagctattagcctaccctgattaacgctggggtagcccctcacatctgcccagcaccctcagcagagcctaacccaatcatccaaggttacccaatagagaactcaggcttccactagagtagccgtcacatagagttactgggtcttccaggttctgccacctccaccgtgttttgtgggactctccactgaactcacaaagcacatgtattcagctactccaaagctatgtgtactcaggaagagaaagttctaaatgtttctgtgaccttgtgccactgatatcatgggttctatccttcagagtgctaagaaaagtgttaaatctccagaatagctttggaaaagtggagaaatttgagactttctctatttttagttgctaatatgcattcctgaaaagtttatttaaagccacaaggaaatatttccatattgaatttcaatattgcaatatactattttagaataaaatggaaagatccaggacatagagcagctgagaagctacacagttggcccctgggcttcactcagacagtgcttctctaggctgcaagtcataagtctttgtgtcacccacttttagaagacatcccccggacttctgggaccaacctgaggtttgtaggaatctctgaggatcaatgatcaaacatatattagcttgaaaaaaaactaatatatgtgtatgtttttttaaaaggttaagtttttaacaatttagacgtcttggcattatactctgagaacgttaaccaatgagaataagagtgacaatttagatgtaaaacctcttaaaggtaaagataaaatcctaaccacatggggaaaaccatgtgttctgtggatgatttccctggatttctcaaaagactcttagaatgttctgggtatgactttgggggcatctgttctatgaagatgggcaccccagcatcacctgcatattaacccttcttcttgctcctaaagatgcagaattagctgagattaggaagatgtacaaagtgttctccctgcacttcaactaatgaacaaaactttttaaaaattacttatgatttggaactattttatcattttatatatcctatggcaactggcattttatatttaattttatcatcttttgctttttttctttgatctaaatcaggatgctaagttttgggggggggtcctacagttttggcagagacctcattctaaaaaagaggtaccagactattaaggcagaatctgctgagggtggccccaaacctggtctggtgaacctcactcaactcatcattgatttcaagggcacagaagaggcaaggagatgacagcaggagaaatggacatgtaccatggagaaaggggaccaaccacaccttctgtccaaactgagatttcccagcctgaaacaggtcaacactggggttagcaagaaactttaaactgaataggagattaaagtaataagaagatgagtactattattggtacaaattatattggtaatagttttaagtttcattctttaagacagggtgaatcacagtcccttctctcaaggtccttgtcagcattctacttttccaaggacattcaaaaatttctcatccaaagtcaaacattagtgtgtgtgcctcaaacaagaaatagttttccatcagtctccaaatctttgaatagtaaatggcaaaagtatggaaatgcaagatggagtggggcttaatgttgccacaacattcctacaatactgggatagtcttccttgggaattactttctttcctatcacgtatcaataaggaaagccaaatgtagaaataaagaaatctccccgatttacttaacacacggaggtgacagttacagcgcaaattgagggaagagtaaatgatttccacaaatgaaccaaaaacacttaaaagccacatttaagagaaatggagtcataaaggcaatatttgtgagcagataaaaaatcagcacagaaaaaggtgagaaatacacaatgtctttcatcaaggtgcaaggaaatgtaaaataacattaaaagtaccaactacataatttgaatataaagagaacaatagcaagaaaggagaggggaagtgatggcgatatggagacacagtctcttttgcatgcacagggcagaaccggtgcctcaggctggagggtgtctgtgagtaccccacaatgaaagcaaaagagcacccagcattgaagccacagaccttgctccatgaatcctagctgatgggctggcacagagagatcaggagcagaacaaggaaatccataggaggatcctcccaaagtacttttttttctggtccaaaaatccttaaatctgtcagaagcaggaggttggagtgggagaattgcagagcctggaacacacctgcctgctgatgacccattctgagggggttctttccacttggcagcaatggacttggtaaaaaaaataatagatccttctccatggatcccatttccctttttttttttttttttttttttgagatggagccccaggcagaattaaagaccaactctgggacccaaatttttagaggacaaaggttgatataatggccagcacgatttagtcatttagatttcaggtctaactaactgatgacagactttaacaaaatcactgaaagaaatttaacgtcaaccttaaataacagtagaggcaggtaatataacaaatagagtcaaaatggtttatctaaaggtctaagcccaagaaacatccaacaataaaattaatctaaaacaaattttttaataatcatttttttttcttgagacagagtttcgctcttgttgcccaggctggagtgccatggcacggtcttggctcactgcaccccctgcctcccgggttcaagtgatttcctgcctcagtctcccaagtagctgggattacaggcatgcgccaccacgcccagctaatttttttgtatttttagtagagatggggtttcaccatgttggtcaggctggcctcgaactcctgacctcaggtgatccacccaccttggtctcccaaagtgctgggattataggcgtgagacaccacacccggcctcatcttttctttaacattacaatttcccatcatggtggcacttgacagtagtgggactgtccaacagcaaatgaccccatctaagcactcaggacagaagccattttaggtcatgaaaattatacagattttgtgagtgaagggcatttagttctgagcagaaagtagtcttgcaaaagggaaatttgcaacaacaacaaaaaaggacaaggagggtgacaatgtcaagcaaatgataaccctgctggagcttcagaaggaaccagctacatccctttcctgcttctacagatgctatggcagccccagaggtgtcccactaggatctcccttcaagaaagaatctagcatgcatctgaacaacctccagctgttcacacctcaggccctgcctcatcccagacagccctgagccaatcactgacacagcagggtactagagcctggtcatttctgcccaacccggggcccctccaaaggcaagctctgctccagacctccccgttgggttggtcaaactatcaaatctgtacctggtctgaggctctccctgcccagtcttgcttcatcctcattttatccttcacaggcacagcccccttccccctccaataaaacactaacattcctaattccgtctcaacatctgcttcccagggaacctaactaacacaatactcctaaaaccaataccagcaaaaagtgactttccaagcccctacatgaagactcattttctggaaaataaaatttaatataattccaattacccatgacgctatttagccatttcaaaggaaatgagaaagcttcccaaattgtggtcctcatggagtgaactgatcatcaaatgttgctgtttacatgagggcacacaataattagggttgtatgtaacatgctactttcagattttcaggtaagtctaaatgcttttaattgatgcaagaataataagtccttcagttgatttatgtcatgcattaatatcaatcaaaaggttttctaacacatactttttaatactataaaatgtggggttttttttaatgtcttttttttcttattcagagccacatttcttcacatggtatgttttacctaacctaagggttatgttgttcgtttgtttttaatttcaggtttgaggaatcaagtaacaggtctttctaaatccttttattggatatatgttagttttccattatcataaaagactgaggaacaggaacagcagcatattgtttaaatgattcacaggtaaaaatatcttctccctcttggtctgttttctttcctgatgtctttgctcattgccaacattgtctattttatatataattcttgcaggacattgtgccctgaaggtgaaattggacaggtaaggagatgacccaacaccccttgtcacacctgcaggctctaggtcacttttgtaacacacaatgaaatgggtaaattctacacaatcctttttttttttttttcaaacaataacagaaagtaaatatttgaactgggggctttttcaaacaacacaagtcagaaaaaattgacttgtttttgactgttactttaggcatatatttttgattaatgacaattaaatgtaaatataaagatattttaaacttgaggttttaaaacaaagaatgcaagaatcacctggttaaagttagatattttgtcagtctcaaagtcagttggctggataataccatatcataaaattttataagactaatttgaaggtccatatgaattggtattattgttcgtttttcaatattgatcttagcagtgtatttacagcatacagcagagttaatgtttaatacaaacaaacaagactttccagaaaatctacaaagaatcactaactaatagccatgcttcagttaaatttgtttactttttaaagtacattctcagaagtaacatgtactctcaattaagtaaaacacaaccagaattttggaatttgatctttaaaataataaaaaaactttctctgctatttacagccttggttaaaatcccaacatctggataccagaatctgagcagcaaaatccacggagacacatgtgcaattttatgcctgcaagctcactattatttagaacgaaaccaacgtagtgcatctacccttgtttcttgctacacagaatgtatccagagtacaaactaatgtagattattataaaactcagtgtgtagatattatatatatatacacatgcatacatacacgcacatatataactaaaacaaaatcttcaaaaataatactttttctttctgtatgtgatgtgccctgatagtttccactttactccatcccatttccttttgttaatactggccttgactcacttagacaaatgggtcatgacctgtagtttggaaaacagggctttccagcctggctttaaagaggctggtcctcaggccagcagaaccagcagcacctgggggtagtttgtggcgcacaatctcaaggcctgccctagacctactgaactaggatctgctcttagcaaggtccccaggtgacttatggatgtattaaagtttgagaagccgtcctcctgcatgcaaaagtacagaatgagtatctgtgatctgaactacatttaaatcgataatgcacctcttaaactgtctttgttcaaagaacttctatcctactgagctcaaggagcaacacagtttctagcaagataggtgcaaagaaaaattcactttcaatttcatcaactgcttcaagaggttgcagggactggctgacctggtatcccagctcctgcaggaccgagagtgtgggaggtgggttgaggggaggtactgaattgactgcaatagatccatgagcatataaaagtgtgcgtgtttgttcttattcctgggagaaaatatatagtattcacctaattttaaaagagttttatggtttaaaaagttaagaagagctactaagccatgaaaagacgaggaggaagcttaaatgcacattactataccagataagaaaatctgaaaaggctacatagtgtatgattccaaccatatgacagtctggaaatggcaaaactatggagatgtaaaaagatcagtggttgtcagggcctaggaggtcgggagggatgaacagacacagctcagtgaatttgaggggcagtgaaactaatctgtatgatattataatggtggatccgtgtcatcacctgtttgtccaaacccacagaacatataacaccaagggtatacggtgtttatattaaagtataaccctaatgagaactctggactttgggtgataatgatgtgttgatgtaggttcagcccttgttacacgtcagccacccatgtgggaaaatgttgatagtggtggaagctatgtatgtataggggcaggaattatatgagaacacttgtggtatatgctcaagtctgttgtgaacctaaaactgctctaaaaaataaagtctgtaggtatctatgaaagcgcagacacatggtccgtgagagcacgtcctctctgctataaattggttgtatggttacaatcatacctagaaaggagagaaaataaagagtaagtgaataccgacatgttcaattctgccccagaatacaacaaagtccctgaatcactcttgtttcattgttgccattgcttattcaattcagtcaactcgtatatgtgaagcatgtgctacatacataacgtataatgcaggatgcaaaaatgattatgtgatcacttcaagtaatttataatctagcaaacatataaaacaggcacacagataatccttacatagtaaatgcctcctttttccccaaaatggcaaggagacaaatagcaaggatccgaggacagagaggcaaaattcagaaggccagaaaggcatggagccagaaatccaattcactcgcgagtaaggtatcgggagagagtggtgtacaacgtgacagggacacctgttgctcccaattgtaatcttttctgattggtttatgcccctttccaattactgtgtccatgctaattatcaactatttttattatcaaccctgcagaggggactaagagaaaaaaaaaaactgctgcaaagtgatgctgtgttcattttgcacagaacccagaaatcctgatgaaggaaactgaattggatgccacaagccttatctcctgtgaatgctgaatgactttgtcggtgggttttacgataagatgtactttcttttatatctattaaacaagctatacagaatactggtaaatacacagaagtaaaaagaagaataaaatagataaaattttctaagttaaaagctaagggaaaaataaaaagaattatcaattgatgtgatcaaagaaaaatgtttatctcatggggtgttggaaaaggaacatcataaaaattaataggtagaataatcatcaaaaacaatctgcacaacaaatattacatagctgaggggaactatcattaaaatataatgtatacaaattgctgagaaactcactacaccttctaaatcatgtcaaaagagttgtttgcatataagctgtctgcacttcttctctctctctctttttttttgttcatattcactgcaaggtggcttttgtccacccatgcaaatcactcatatgaaggtcacaatgatgtccaggtggccaaagcctgtggctaatcctcagtcctcatctcaccgagacagcagtttcttagcccttctcctacctccactggcttctcttctcagctcctctgtagttccccctcctctttccaacctgtatgcattggaggggcccaaagctcaaccctaatgctcttctgcatcttggtccctaggtgatctcacctagtcacccagcctcagatagccttaggcttaggaatcacaaatatatctctcacatgacctctagactcatatcaacctctcaacatcacaatttggatatccaacaggcatctccaactcaacacagccaaaccccacttttgacttcctgctcattgcaactgtcccctcttgcagatgtcccttttagagtaggtggcaccatcatatacccagttacaaacaaaatctttaaagtcatccttgactctcctacactgcatatctaatccatcagcaaatgctgtcttttccaccttcaaagtagatccccagtctgatcatttctcactacctcccctttcgctgcctggtgcctggcaatggcctcctaattggtcttccctgtttcaactcttggtccccctctagactgttccccacacaacagccaacatggttcttttagaacttcaaccaatgtaaattatacttcaagaaagctttaaaaaattcaatcagatcacatctgctatgaaccttccaatggttctcctcccgcagtgtgccaaataaaatggaaatgcccttatccttgcttaacagaagtctacaacacagcctcaccagcatgcctccaactcacatcctgcagctttaacctcactccacgccagcccccagtctccttgccgttacttgaaagtgccaggagagctcctgccaaagggcctttgcacatgctgttccctctctctgcaatactcttccccgtgtgatcatacggctcatgctcccactcccttcgggtctcagcttgaatgtcacctcctccctatgaccttccctaacctttcgtgtaaaattctacctctcccttcctcagtctcttgcttctcctgctttgttctggagaataccaaccagcaccacctgatttgtaactattcccttgagcacattctatctcagccacgggaatggaagcttcatgcaggcggggacatcatctgttcagttcatgctgtagcccagcaattctgaatgattagattgaaattggatccaaaaatatcacaaatgagataacgtaacttgttgataagtgtgtgaagagtatgaagagatgatcaagctcacaagtttccaagtgctaacatctataaaactccattgtcacccatcaaatcagcaaagattaaaaaccacaatagaatgtgataaaatagtgctctcagatacttcctggagaagtatagatgggcagaattgggtgatctggtatcaatgatcattctttcataccaatacaccatgggattttgcgatcagaaggtaaagaagacacagaaggaaaagaaggtgaagattaaaccagcaaaaacccataataagtaggacttcttcctattcattagtaagaaagagttgggtgtccccatgggaaaatgctaatttagtgtcctgaaccactgtaccctccaattcctgcttcccccacaacagtggccccacactgagtcctacaacgaggataatgatcctcaacccccaattgcacagacagggctaagtcagagacagtgatgccaaccttgctgatgtctctaaaacactcaactactgggggctaaccctaagcaaaattattgactccgattcctaagttaatttcctataaggtggaagaagcaacaagtgtcacttctcttctgggctctatgacaccaaatagtggagccgaagagacttgctgatgttttgaaacccaaggccaaataatgctctctaaacccttagaggtgtgactaggatattcacagaagccacgcaaaagacagcagccttcaatgaagaaacaaagaaacaaaaaacatggttccttttataaatatttatcgattatctaaggctaggttaattgttgataactatcaattatctgagcaagatacgcagaaacacttcaggtgcttgaactgcagcatcctgggctccaacccaaacttactggagaagaagctttagataccaggaatctgcattttaaccaactcctcagggaaactgccccagagggggtctaggctaaccatgcgcaacttccacccattctcctgggaagtgattgtgaatctcctccaaacccctcttacacttcctgattaagttggtgccccctactgaatgtcagcctcactgaatcttaacgaggaatcgccagactgggggggggattgtgcagcatgtctggggaacacttcactacttcactaaaccctgctgcacacatgctgaacaccgttccaaaggctacaggaactgagcaccgcattggaatctggccctggagggtgcccagcatggcgaccctgaggggtgcaggaacccagtgagaaggagaaacagaaggtacagtccagctcgagaccacgcacataaagaaatctgtaggcagggtctctattattgtgccatattaaatatcttgatattttaaagcaatattatttttctgattataaaagtactcattgtagaaattttaattgtgccatcatcctgcagaaaaatgaaagtacaaaaaacgaaaaagcagctatacacggccacaaagtcacagggctcatcgggatgtgctaaccaggctggaaactgatcaaagctgatttattgagaaaaaataggcagcatatcaaagacttacatcagcttcatagtagacagactttgggggcgggggaactctgtctcttttgagtatattctcaaaaggataaactttcaccttcctgtgaagcacagttactataaatcagatttgcaaactgtgagaaatgcttacaactcaatgagtcttttgtcagccagtgggggctccatcgtgaaatccacccttcgccatagcgatgggataaatcatcaccagccccgagacatcgcctaatcccttcctcgcaaggcagattcgggcgctttctgcatctgcttcgtgttattgaaaagagctcggctcatctgctgggctctcaggcttcacagtgacctcgcacagaacgctgctacttctgaaactgttttagactcttccgtctatgaaacagacacagagtttaagtttagcgtcttttatggtcagaaatatttagcgttacttccagagcggcagccgtggaacaatgtgggaaagaagtgcttcagttcacttcttgggaagtactgaccctgggtcaatttaattttttccgtaagatttccccttcttacttttctccttccactgctatatgtaacagtatctccccttccactgctatatgtaacagtatctccccttccactgctatatgcaccagtatgctagtatacaacattatagattaataatatgctatattgtttaaaaatattaatgttatataattaacatggtgtgcatattattatattgacaatacgtaatgtgatgtgataataagtctcactgagtgccaggcaccgctttgaatgctctaaactcattagctaatttattcctcgtgattctatggggtagatgcactatttcattcccattttacagctgaggaaactgaggcagctagtaacaggtggagccaagcttcacactgagatcatctggccccagcacactcataaaaatgagcaaaagtataaaagccaaagggaaaaggaagccaaggggtgaaaatcctaattacaaacaaatcctgggtaagctgggtttttagtccttccccacatgtgaacagcaactagaaacctgaacagtgactttgtttcccctgtcatccattgttggtgcctgatcctcacacaaaatcttacggagcagtatctagtgattagcttagctgaattgagcctggacacccttcatgagctggaggacagaggacgtgtcgatggagggtccaacttcaggcatctgtactcgcctgctacaggtgagtggacctatgaacccccagcctcatcaagcacccgagggtcacctgcctgcttcacctggaagagacagcaaggtgtgatcccaggaagatcctctgccaggaggcttacaggcagaagcagcggctgctgaacatagatgctgtcggcaggacacaggggtgatagggggtgagccagtggagcaggtgaaggtgcagactacaggcagcccccctgagatcctgcccagaccccagcagcagctcccctgtccctctctagcagcttcgctgtgcccgaagtgtttgagaacaggtgacccatgccctgagtggcagatgctgtgtctttttgatcccttctctccctccccccccacccccagtggggtacatggaaggtttgctaaatgtttgttgaatgaataaacgagcccaagtcagaagcagtctccaaatcattcctcatcgcaaaagggtgcggtggaaaaactcacaaagccaaggcaggaggacacactcaacttggaaacggcccgtgcccagctttggaacaggcacagcctgagcttcaaggaagtcacttgaccagcagtagctcccacctttccttgcagctagaacagcatcagaccaagtgatctctaatgtgatgatttgctaaagtacaatgagttttacaactagaaagtaccttcctctcaagactgacttcactatgagccacctaatttttcctctctcttcttttggtatttttgttgcaaatagtacacacaaaacaggatatataatctatttgtgcaatttaaagaataagaagcaaacacctttgcaggtactccctagtccacaacagtcagccccaggacctcagaagccccttatgcctttcccctaaaactctcccctccctgacaaggtaattccaatgctgagttatgtggttttttttccttatttttcttttcaacacatattacgtttctctgaataatatgctttttaatgttgcctctttttaatctttatttgtggaatcatattgtatgtaatctgtgacttttttctactcacatatgagaaccatccacactgatacatggctacagatagacacttggagtttatttttcactgctgtatagtactccattggtggagtacaataggtttatgtatccacttttctgtagatggacacttgggttgttctgtttttgctcatacatacctcctggtgctcaggtacaagggaatacagacccagggtgagactgctggatcacaggctaggcacatcttcagctttactaggtaacaccaagccaatacaaaagtgcttgtacaaactcatgctcctgccagcatggaggacccactgtgccacataaaaacatcactgttattaacttgttttatttgcatatgattattttttcccttatccccaaccacttctcaaagcaactagccagcatgtgccacacaggcaagcacccactccaatgtgatctatatggttaggtatgtatgtaccctggaaaaccctgtgatgttgcttgaggagtatataacttttttatgtatgtaagtagcatgtgctacaaagcgcgttctgttttctgtatttttcactccactcagtgttttgtaaaacatgctcatgttgctccataggtatcagagacaggatgatgttttatctttaagatgggtacgccaccctcattttatagatcacagtgatagctcacaattgtttagtactcagtggggtctaaatgtactaactcgtttaatctcccacgaaccctgcaaaacagatgcttccgtttcatataaaatgagaccaaggcacaaagaaactaaggaacttgtacaaaatcaccaagttagtaaacatcagagcaggatttgaattgagccagaatgtgttcttatccacgacatgaaactggataagaatgcaaagctcagagaattttcatgactagcatctctgggattcacagctggcgaccacggagcagaactaatatacagatggttcccctctcagtccagtcctcattccatcggctccaaaatgtgtattattctatatgattagctggtgaacaacaaaggcaattagttagtcctcttcagcaaatgttagtaaatgaaaatattatagagacagaactctttttaggaaatgcaatcatgtgaatttaaaaatgctttatcagaaatagaattaatgacaaaaatatttataggatcctaagaaaatggatttgctattttttttgtcggctgatgataatcatctgggtgcatctttggttgtgacagctccaccccttcagagagttgtatcttcatacacacctaacatgctaagagtagatgtgcatgatatggtagttagtataatttctgtaataaaaaaagtacttggtcatgcctgtaatcccagcattttgggaggctgaggtgggaggattgcttgagcccagagtttgagaccagcctgggcaagatagtgagaccttgtctctacaaaaaaaataaaaattagctgggtgtagcggtgcacacctgtagtcccagctactcaggaggttgaggcaggaagatcgcttgagcctgggaggcagaggctgcagtgagccataatcataccactgcactccagcctgggcaacagagcaagactatgtcttaaaaaaaataaataaaaataaataataaataaaaaatttttaaaaaaggtacctggaacggcctgcaaagaaagggaaatcaaattatgcttcaagacagtcactattatcactgacagagaagcagctaaaataaacagcctgctcattttgtttgtaaatgaattgccacaattcttgcactatttaaatcaagaatattttatattccatagttttcaaccacccctcctttttttattgtttccagctccttaaacatataaaaggataaaagccatttgttctggcagaaaagagtcatcataaattttgcagagtgaatttctctaagatgaaaggaatgttcctctcctccaggacagcctacggacaggactgtgatgacacagagtcttcacgggaatcacacctgcagtgttaagccacttctgtggaaaactcaagtccttctcagataacaaaaacattttagtagcaatgaaccaaaaacaaaatcttccactatatatgttaatacatcaaaaggaaccattcatgtgccatttataagaacttccttccggccaggtgcggtggctcacgcctgtaatcccagcactttgggaggccaaggcaggtggatcacgaggtcaggagattgagaccatcctggctaacacggtgaaaccccgtctctactaaaaaaaaaaaaaaaaatgcaaaaaattagccaggcgtggtggcaggtgcctgtagtcccagctactcaggaggctgaggcaggagaatggcgggaacccaggaggcagaggttgcagcaagccaagatcgcgccactgcactccagcctgggcaacaaagcgagactccatcaaaaaaaaaaaaaaaaaaaaagaacttccttcccagaaatcatagcagcgttcctcagcccaaagccagaagaaacttctcgcacatgaaattttacttcaaaaactcccatatcaggcattttaatgaatcagtggaagaaaattatcctcccaactttgttgtcaagaaccccaatttcatatgcagaaaaaagaattacaaaaataattattcgaattctaattggtgggattttgataggtttataaaggaaataaatatctttaacacaattctacctcgcagccaacatcagctattagcaaccacacttcttattgccagttcatctctccaaacacacagaagccatgtgagttgaaatttattttttaaaaactctcagttatgatttctcaaaattatatttcatatattgacatcaaccaatatgatgatgatattatatattgacattaaccaatacgatcaaccaatatgatgataattgtagggaaaagaaagagagatctgactgttactgtgtctatgtagaaaggaaagacataagagactccattttgaaaaagacctgtactttaaacaattgctttgctgagatgttgttaatttgtagctttgccccaaccactttgccctagccactttgacccaacctggagctcacaaaaacatgtgttgtataaaatcaatgtgtaagggatctagggctgtgcaggacgtgccttgttaacatgtttacaagcagtatacttggtaaaagtcatcgccattctctagcctcaataaaccaggggcacaatgcactgcggaaagccgcagggacctctgcccttgaaagcggggtattgtccaaggtttctcccatgtgatagtctgaaatatggcctcgtgggatgagaaagacctgactgtcccccagcccgacacccgtaaagggtctgtgctgaggtggattagtaaaagaggaaagcctcttgcagttgagatagaggaaggccactgtctcctgtctgcccctgggaactgaatgtctcagtataaaacccaattgtacatttgttcaattctgagatgagagaaaaaccgccctatggtggaaggtgagacatgtttacagcaatgctgctttgttattctttactccgctgagatgtttgggtggagagaaacatacatctggcctatgtgcacatccaggcatagtaccttcccttgaacttaattatgacatagattcttttgctcacatgttttttgctgaccttctccttattatcaccctgctctcctactacattcctttttgctaaaataatgaaaataataatcaattaaaactgagggaactcagaggccggtgccggtgcaggtccttggtatgctgagcgccggtcccctgagcccactgttgtttctctatactttgtctctgtgtcttatttcttttctcagtctctcgtcccacctgactagaaatacccacagttgtggaggggaaggtcaccccttcagataataagataaatcagagccgaaaacatagttcattcctgaaatcaaatatagaacgtttctaccaacacacattttcaaagatggtgttttcaggtttgtatgggattgtttcacctttatgaattagctttttaaaacctgtaatactttcttgctgacttcatcatttccttctggttgcctggaggggtggtgtggaatgctaataaaatgaatttcagttgccgtccctcacaatctgaactatagaagatatttattgtctcaacttccctatgagcttttctttgcatcatgcagcttcatggtcagcagacactaaaaattaaagaaagtctttctcccactttacttgtgtagcacagacacactgatcaaatatgttcccagcacttccgaagaaaccttatcacatccacaagagatttcctacttgcactttttttgataaacacaaccatcatagcccaacaaaacatcacacagaaatcaaattatagtgtccccataagcatctgctcctctatggccttgggcaaaatttagaatcctcgacatccctagagttaccacaatctctgaaagtgaaggagcacccacaaagctcaaggaatgcattgaaactcttattacttccaattccattttcaaaaaaagtaaatgtgtgtgtatgtgagctgcacatggtccagaatgcctcaccaaatgtattgttttaaaatgtgtgtacgtccatgtgtaattgtatgtgtgggattttgaaaggctttttatattttattcaaaaaggtacacttttcaatatcacaaactttgctttcaattataagcccttcccattttcaattaatgttttaggcaaggaatatacattagtaaaaccaaccacaccacttagggaaaatgaattagtatggggaaagtgaagaactggccatgcagtcaattactttggccagcatagatatagttgaactaaccagcacaggtgtagacagcctgtttggataaggtagcttaagccccaattttttctgcagtctttatttttgtcaaatatatgaaaactaccatctcatttcctccctgtagctattacccacatgtatgtgtagtgtcaaaataaatggccagagtcctctcagggacctcccttggcacaagtcgcacttcctcaccctctcacctccagagcctcaggaagtgcaggtcagaaagcagccagggcaggtgtgaggtgatggagcgctgagtgtcggcgagcccagataaaacaacgttccaacatcggaaatccaatcattcacctacttgtctcctgctcgctaaccccaggcaagtataaaggagatggaattataacaggagttagaagaatttggatgtgatttcatatattaactcagcaaaattttttctgaaaaggtccagacagtaaatattttcagctggcaggccatatggtctttgtcgaacctactcaactgtgccattatggagtgaaggcagccacagatgatatagaaatgaatgcatggggctgtgttccaataaagctttctttatggacactgaaatgtaaatttcatgcaatttacatgtgttacgaaatatgcttcttttgatttttcaaccatttaaaaaagtaaaaaccattttcttagctcctgggctgtgttgactgacccctaattaactgatatgtgggctgctatccatgaaaacctaggcacagaggaaggcagagctggcttcccagccaagacgggacttaccttgatatgagctgctgggtccgggacagtctgaatcatgtccttcagtaagccagcccatctaccagctgttcagaacctgacggctagaagacaaaaggaacaacatacataataataaacaactgcatttctgtgttttatgttctagcaggacaggacacaattcaccaatggcaaaagaatcatagctttacattaaacatgtttgcctaaaggcatcctctaggtacgtgtggtccatgaggtgactagataactcacttcccttccattgggaaaatcacttacaatgagcccaagagaaccctagtccgacaggacagaagaatctagctcaagctaacccacatcacatgcagcatccacacatccttccacgtgggcagcatctaatgagggatccattaaaggaagacgtgggactaaaacagggcatacttctctatcatactgagaaaacaggactttgaaatcccaccaaaactcatgcgatctgcacatccttttcagctttgttattaagttcttagtaaacagcacagctaccattcattgagtacttcagcgccagttccttgagcgctaagggctccacacacattttctcatttcattccaaccacgactctgagagctgtcattcccattgtccagctgtggacgtcaagactcataaaggttactgatttgtccaggatcacctggttaataagcgacagaaccaaacttcaaatcagattaggctatctgactccagagcccaaaaaaaatttggtttgacttaattagcaggtatcaacccacattttgaagggacattttaaaacaccgcttaaataaattaaatttaaagatgcctataatccaggaattttccagaaataaatacttcatccaatatattcctttattcaaattataaagcagcatgttctgaccactgtctgtgccctccccttccaccgagccagtctccaacctccctttgctgtcacaggccccagggctgacctctacagatgggctcagcagggtgccttgcctcctggccacctgtcagggttggttgacgtggccccctctggagagcaggggtgagaggagaggggtatctcttcccctcaccttcccaccaccgacacctgccgcccaacctccctgggcgcttggttatggttctgactgcagctggattctagggggacctctcccgtcatggggcccctccttccaggctccagcctccagtacctggtccccagccagtctctggtgctctgcagatctcagccaagccatcagttcttttttggcactaaaaatgccttttttagtttacatttttagaagccatcacttgctttttatcacctgtagttttttgtttgttttctcctttacaatggctctttgcagtaacaaatgcaaaataaaaataaacaatatgattacagaacttgagacattttcgaaggctgtctttcaaatttgctactgagcgcattactgtagtgacaagtgaaagcattcacaggagtcctccccacattcacatctgtcctttctgacctctcacggtacaggcacacccattccaacccaattgcctctcatgaagagcatctacctccagatctgcatgctccacatctgtcttcagtctccctggaggcctcccaagattggcggagcttggctcaccaagaagatgacatgctgggaaccttaggcattttttttctataaccaaatttctaggtcttggaaaatatgtacttccccccacccccacccccaggcctaaagtccctctgggggatgagagttactgaaagtacagagggagtgaagtgcagtcctgaaattgaaccgggaagcagatgaaggtgaccaggctcctggtgctctcgtgggagaagaggctgggagaggatggggcctggctgaaggtttctgggagcataggaatcctcaactccccttatcctaagagcagcaggtgccacaggaaaacaccactctgctcctggggtcattcagcccggaaggggagcgtctgcaagccatcctcacaaagggagggcgtcccactgcacaaccctgctctggggagcacatggctatttccgtatgtctggacattctctctggactagttcactccgcacagttcctccctgcctgcacacacatgctgacgctcacaccagggactgaagctcgtccccctcccctcaaacccaggctgacctgtggctgcctctgacctgcagaacacagcagagggaaggtttcaggagtcccaggctcaggcctttatggaagtgggagcttccccttcctgcctcctgaaaccaagtccccataccctcagcagcacagcacatggcagaggaccgagtgcccagtggggcagccagcaccaacgccaggcccgggagggagttgtcctggacagtccagagaactgactctcagatgaccacggcccctgccgacatcagggaggcagcttccagctgagtccagtcagcccacagaatcatgaccaataataaatgggttgttgtactaagctgctaggatttggggtagtttattacacacacaggtcattgaaacaccctgtaagtgctctagaggcacggagaagatagagggtaaatagcttgtttcactgtcactatggataagtacaaagatggttccaacactcaactcctcctgtacccatgctttttgccacataactttgtgattcttcccattaaagaggtagaattacttcccaacccttatttttgggcggcctatatgatctgcttcagccaacaggcagtagcagaaagacaagtatgacagatcctagctgaagcctcaggaggcaggacatgttcccctttgcttttctgtaactttccaccagcatgggaacatggccagatgcatgcgggaggatgagaggtacctgaggcagagtcacccaccccaatcaccccaccaagactacgtttgatcatcccatagacaaccaaaaccccagacatgggagggaggcaaccagaccagccgctagccaagtccaaccagaatggccaacccacaggctcatggctgaataagtgcttactgcttgaagccactgaaatttggggaatttgttacacagcatttttgtgacaatagattactgacatacactttgcaatgtacaatcagattaccgagatcttcgttaaaatttttctagccagtgataaaaggagactcaaacagggcatttcaaaggaagccacttcatcccaacacagagacataatatttccactcacctacgagacatgatctcaaaccctaatcctgccctcaaaatgggtttggaaactgaaggataaccaagaaacctccaccagaagcctccatgggattcccagagcccttcccaggagcaactgaattctcacttcacatgatgccctgccagcctcccctggattccaaaaatcaaaacatccttggatatccaagaccgcagcaacatcatagaagttacagcagccactcggtctgtaaccaaccaagacataaactaaatgagcaactgtttgagtctcttgtttcttatggggaagttttgagtactcaggttgcatcaagtataaaatgacagggaagggaatagatagagattccagatgcaacacagtcctgatccttgagggatcgagatgggaaacagatctgtttcatacagatatgaagcggtcagtcctgagagcaggcagttagtggaggtgcccagtgaggcgtgtggatatacctagaggaaagagagagctgattcatgcagagacaagagggtgccaccaaggagccttgatgaacaagaagcatgaggactggaggaaagagggtgaaaggcatgaagcagggaacctaagtttctcccagctctgccacattagagaccaagggcgtatgagcttctcacaccgccaccaccagagtgatcacacaccaaagggattcactcagcacgcagcgtgatggcactgccaccctccacaccagctcagcgaaaacccaacggacctaaagaccaggagaataaaagctcaaccaccctcccctgcctcctcaacccacacggatctctgactctttttttttttttgagacggagtctctctctgttgcccaggctggagtgcagtggtacgatctcggctcactgcaacctctgcctcccgggttcacaccattctcctgcctcagcctcccaagtagctgggactacagccgcccaccaccacgcctggctaattttttgtatttttagtagagacgggatttcaccgtgttagccaggatggtatcgatctcctgacctcttgatccacccgcctcggcctcccaaagcactgggattacaggcgtgagccaccacgcccggctaattttttgtatttttagtagagacggggtttcaccgtgtcggccagatggtctcgatctcctgacctcgtgatccacccacgttggcctcccaaagtgctgggattacaggcgtgagccaccacacctggccctctctgactctttttgcagccatttgagtgcctgttcttttttaccatttcagaggtattttatggattttttaaagagtacttctaatttacttttgtgttcctaatggtcatttctcaaatatgtagtagttggtaaccaaacaaactaaaaccatactaaaaatttttagtagttggtgatagtttcatgtcactgtaggaacctttttattttctattttacctgcctttgaacccttgcagaacttcactctatgttgattgaaaatcatttctttaatacttgtttcttgcaataaactcatttgctaaggtatatacttccatatgattttgtgtttcatgacccagctatattttattattgggtatcttaaagaaacaaaaaaggccttaacaataacagaattctacttgtgtcacttctttgtttttgttttcaaaatgccaatgtcttactaaatagaaacaaacttgatttgaattacgtaagctctaaccacataaaaaagatggactggtacccaaggtagaagggaaaataagcattttgtaattatggaggcagtattgcaaaatggttaagagaaggcctaaatatttgcagggctggtgcaagaaaatagatggaagtttgagacccctcgaccctacccctcctctcttctcaaacccaattgtgttctgcgggttaggggatgcatatagtcacgtggacatcccgatccacatggccacactccattcagcaatgctccctgctcatctttcagacccagggaaacacacacaagatcttcccaagaagatgaactccaggaaacaggctggtgcagcccaaaagatgctcagtcaagtttggaaaggcactctgggtgccccagcacctggggcatgtcctggaatggggatgggttcagctggggagggcaggaatggggcctagaaggcataggcaggacgctgggctgggggcagtgctcgatatgagcacagtgcagagccagatgagggatggaaatcagatctgccacttactccttggaaacctataaatgatcactttatcctccaagagccttagttacacatttgcacaatgaggataatattactgtagtataataagaactccatttgcccttgtctctcgtttctggcatggagctcctaaaactctgggaatttcccaagtgatgggagcatcttttgttctaagaaggcagcaggttggtgagtccctagatagcttcaggatgggggctaattgcaagaaagagtgagtcttgattagatgctcagaaccttcagccccatttcccaacctctcaggagaggagaggagctagaaattgagttgatccccagtggccagtgatttaatcaatcctgcctatgtaacaaaatctccataaaataccctgacggggttaggacagcttctgggctggtgagcatattggtatgaagagtgtggtgcaacccaatgctaaagggacagaggcggccaggcgcggtggctcacgcctgtaatcccagcaccttgggaggccgaggagggtggatcacgaggtcaggagatcgagaccatcctggttaacacggtgaaaccccatctctactgaaaatacaaaagattagccgggcgtggtggtggacgcctgtagtcccagctgctcaggaggctgaggcaggagaatggcgtgaacccgggaggaggaggttgcagtgagccgagatcgtgccactgcactccagcctgggcaacagagcgagactccatctcacaaaaaaaaaaaaaaaaaaaaaagggcagaggctcctgtacttggaatccttccagaccttgccctgtgcacctcttcatctggttgttcattcatatgcttaataataaactgtaatcataagagcatagcgttttcctgagttctagcaagttgttgcacctaaaaggggggttgtgggaacccccaatgttgtagccatgtcagacagagtgtaggtaacctggggacccaatacttgtaactggcatctgaagtgaggacggtgttggggagctcagcccttaaacccatgtgctaacttccggtagtcagtgtcagaactgaattgaactgttggacacccagttggtatcagtgttgaatgactggttggtactggcgaagacatgatgtatttggtgttgggaaacatgaataaaaaatttgtaaaacctccaaacgatgttcagcaattcacaaaggtgtcagtgcaagagttggcctgtatctattctaactggtcagtatgcaagttgaaccattgtttgattatctcctctgtctacaccatcaggcttttgtgaggattaaactaaattatgcctcagaaagaaaactctctcaaggctaggcacataatcaacactaaacaagtggtaatcattataattaagaaagtaaaaatatttcaaatggacgattttgatactgtataaaatgttgcaacttttttttttttgagacggagtcttgctctgtcgcccaggctggagcgcagtggcgcaatcttggctcactgcaacctccacctcccgggttccactgattctcctgcctcagcctcccgagcagctgggattacaggcacgtgctaccatggctggctaattaaaatgttgcaactttttaggaaaaataatcctcaataaataaattgctaattttcataagagccctttgtcaactgactaaaaacatccttaatttagaaatgtattttttagttttaagataactagtcattaagtgaaaacattgtaggcaaaatggctctaagcaatttagtattcataggaatgaatccattccttgaaagcattggtcgctgggtgcacttgtcctggatgagcagatattaggcaaatcagtctttcaccagcaaaccctgccataagaactgcacaggcctgattcctgccaagcacaccaggcccctgactggggcagaggcctcccttatggggcaggaagaaggaggcagggagaaacatagggcccatgatttaaggaggctctccctctcaggctcatgcaagtgcaggatcagtacctaaaggggagcaccgcccgaaatcctgtgccccagtcaccttaacccagtccagccctggctcctgcactccaaagctaagcagggaataccagcgggagacagaagacagcatgagaaactgaatgcatctcccacatttatctaaaaataagaaaatggacttcttcagtaggaaatggctcatctttccaaatgaataaaaatacttatagctatgggttgaattgtatcaattctctcccccagttcatgcactggagtactaacccccggtccctcgggatgtgatgatagagaggtagggcctttacagaggcaatcaaattaaagtgaggtcattagtgacctaacccaatgtgactgatccacttacaaaaaaagggacaagatttaaagacagacctgtatagaaggacgatggtgtgaagacacagggaaaagacaaaagaggcctggaacagattttcctcaaagccctcagagggaaccacttgggctgacaccttgatcttggacatccagcctccggaacggtgagatgatgaatttctgttgttttaagctacccagttcatggcagtttgttacaacagcactgggaaaggaaatcacctctatggagggacttacgaaagtcacttaactaatgcagattagaggcctcacagtcagggcatggcctcaagagccacatccattttaattgtaccatttctcactgaactctgaccctggtcaaggcatgtctcaggctccatggactactattccttccactgatcgaccctggcttcattctggcaagggagggactcatacattctgcggcctgcatgagtgtcatgtgagcacccccataaccttgatccctgcggtgcttctccaggggagccctagcattccagctggcctcatgggcatgccttagagagagggagctgaccctctccttcttcaactggattttatttttattttttggcatgttttgtgaatacaaagattcactgcctgggtgtgccccttgaaagaaggtttcaattgcattcaggtgaaataaccacaaaatgactgtaagccaaatgtagtagtatgatagaaaaatggaaatatcgtaaaagcaccagtctgtagacacctagcttctggttcctctggaaaagggagaagagagtagacagtgatggagaaaagaggggctgtgaagactatagaactgagaaggcagtaattctaaaatctccacactgtagggccaggaacaggcagtgctgggcaatggggcatcttatctcagggaagtcaagggtgtcatgtagaaccaacataattcatccaagtacagcaaagaatccagaaatggtctgtggaggtttggaaccatgaaaatcaaataggaaagatacaaaatatttacatatccacattttttaaaaggggtcctgactaggcagcataagattatttgggttctgttcattttacctttagttgcccttggttctgccatcttttttctctgtgagtcatttgtcttgcttttggtcaacacggctttcctcgggtctccaaagatcctggaataacctgaatataagttgaagaatattaaaccttattttgttttcaaatattaataccagggatcaactgtacatgtaccgacaaaacctatttcttaaacattattttaaaatatcctaaaaggggaaagaacttaaatccttccccttaaaaaaagaggggacaacattcctctcctctgagggaagcccagcattatgaagcaaaaatcgggagtgaaagcaaggccaagcctaactggcatgctgaagcacacagatgcttttgcacagaaaatattttgaaaatgttttcttttccttatagcccccagctttggtaataatggcttccctagatcattctgttagcactttctgctgctcagaacagggtagtgggatttagaatttagaaaacatcccgagaactgtaattaagcaattgtcatagtcccagaaaagaaacaacccttttactttgtaaatgctaggaggatctgtattttttaaaatcttagaacactaactagctaaaaagatagaaagaaaaaaatctttcttacaatatgcctgtagcacggctccaaaatccagtccctctctctcttcttttttttttttttttttttttttttagatacaggaatttcttacacaactttccaagtaaaatattcaatccccaaataatatatttagtagaatccttacaacatgagaaattgtaaatggcatctgtttccgttgaaaatatttttaaattagaaaacatcttaagcactgcatcaaatcaatatttgtaatgggcagaattatttctaaatggttccacaggccagttgacattcccactctacttaggaagcccccagccaactccacctgaagtcttcgaaacctatgcatagaggcaaattgcccagatgtcacagaaaagcatttgttgtgatacagaaaataaaacacattactgggggaaaaaaatcagggtactaaaccacgtacataatatcatcccaatattgcacaaagaaaaaaaaataagtggatgaaataaaagagggaaggcaggaaaggaaagaggatgacctgagaaaagttatcaaaatggttaacagtcatggtctttggctttccagtgtgaaataggagttcttattttcctctttttaaaatatttttaaaattatttattttttaaaccaactaataaaagtaatatatatttaccgtgtacaacattatgttttgaaatatatatatatatatatatatatatatatatatatatatatatatatatatatatatacatgttggaatggctaaagtaagctaattaacatctgcattacctcacatacttatttttttgtggtgcgaacacttgaaatctactcttagtgattttcaagaatataatgcattgttattaactacagtcaatagatcataggtctattcaagttcaagtcacagatctcttgaaattactcctcctgtctaactgaaattttgtgtcctttgaccaacatctccccagttcccctacgctcaacatcactaatcatcaaggaaatgcaaatcgaaatcatgatgagtgtcatctcacacctgttagaatggccattatcaaaaagacaagtgttggtggggatgtggaaaaagggaactcttgcccaccgttggtgggaacgtagatcagtacagtcattatggaaaacaggatggaggttcctcaaaaacacaaagatcaattacaaaacaaaatactatatgttttacaaatgtactacaactcaatttggtatgtattacaaatcaaaatactacatgattgctggcaatcccactctggagatagatccaaagaaaatggaaaatgaaatcggtatgtcaaagaggtaccagccctcccaaattcattacagcattattcacaacagacaaggtatggcatcaacctaagtgtccatcaacataaacgcccataaagaaaagtggtgcacatacacaatggaacactattcagcatttagaagagaaatcctgtcatttgtgacaacatgaacaaacctggagaactttatgctaaatgaaataagccaggcacagaaagacacatactgcatcctctcacttatacatagcatctgaaaagttgaactcctatttccttctttatagttttgtgtattttccaaattttctaaaccaaaaatattcatctttataatcaggggagaaaactaaggaataatcattttataatcctaaacatgcttttaaagcatttatttcactgtaatgtattcttttcccatccagtcatacatgggcccaaggagctggccttccctgctcggcagcctgatgttcaaggggatgggggagggggacggtgcagtagatcatgctttgcaaagctgtgcaaatcttttttttttttttttgagacggagtctcgctctgtcgcccaggctggagtgcagtggcacgatcttggctcactgcaacctccgcctcccaggttcacaccattctcctgcctcagcctcccgagtagctgggattacaggcgcccgccaccacacccggctaatttttgtattttagtagagacggggtttcatcgtgttagccaggacggtctcaatctcctgacctcgtgatccacccgcctcggccaaagtgctgggattacaggcgtgagccacggcgcccggccaaagctgtgcaaatcttgagttaataaacatgttccccaaatccaaaagccaatattgactattgcttggttaactgttttgcatggataagtggttaaaggagtatttggtttccaatttctgcaaagggaataaaagttttaaaagcgtgaactaagatttcctatactatgctattctatagtaggtttttatgccaaaacctctactaggctgaaaggataatttgatttatggttgagacattgttgggcctgatttaaagcccagagtcaagcccagagaggattctcttaaatatgtgcaatgggtatttttaaattagcattatggcgttattaatatttcatttatcctgagagcatttacctgacaacgtaaattatgtgtaacacagctgagaagccacaaaggatccaaaaagatgtcacgaagtccacgaagagaagctttgccagagaaaggcacactaccagccgcgtgagctggcctcatcaaagcaaaaaagtcagaaaattatgtaaaccagactcaagaactcaaaaatacagtcgtttgagaacattggtaagagtgcaaactgctcaccccagctcaatcacccctggtccagcaacggcagaaagccaaggtcaaggagtcacatgacctgaagagacaccccccaccaccaccaccaccctccaagccctgcccctggccagtgggacaaaccacatgacccctgggattcagtattcagtcaggttctgtgttctgtatggggaggtagaagaaggcaccagatcatcaggaaatctggactggaaatggccaaagctgaacacatctgagtacctgaagggtaagcttaaggtgtcaaagcagccatggtgaggcagaaagaaccttgagcttggggccccaagtttatgctgacccactagcagccaacaaaacctccctcagcctcagtttgctcatctgaaaactgtgagtaagaggctctgactccagagaggtggtgcaagttcaatgagaaggggttgctgatggtccagatggacagatgcaaagcactgctttctgtttttgtctttgttttgatacaggattctctctgtcatccaggctggtgtgcagtggtgtcaatagctcactgcagcctggaccctccctggctcaagtgatcctcccacctcagccacccaactagctcagactataggaaaaagagtcatgcaccaccatgcctggctaatttttaaaaaaaaaattttggagacatgagatctcactattttgtccaggccaatctcgaactcctggcctcaagcaatcctcctctctcagcctcccaaagtgcttggattagaggggtgagctaccatgcccagcaaaggcattgttaaattcaggaatgaatgaccaccttgttccccaaaacactagacaagagaaccattctctacgcacagatctccctggccaccacgtgtaagcagcagtgaatattccataggtggaactggctactgtgaagaaagaaaactccagaaaagctaccctcactccaagaagtagcctggaccccacgtgcgtgacagcagcctggggagaaggctccactcccaccagcaatgccaaggacagagcagcagcagccgtccatccccacagttatggtgaacacagccacagagcagcctgctttttccatgtatagccacacacaggtggcaatggcagcagacgtaactggctgcccttcctcccttatggaaggaaacataattttgcttgggtgttctgcctgcccccacatgacccacggaggatgaccagccccaacaccagtgtaaatcctatcactgggcaccatctcttctcaccacggattggtttagggaagggcacatgatataattctggtcagtctaacactcggggaagcgagctagaggacttctaggaaaagtgttggctgatgaagaaaggccatagagtagtagtcctgtctgtgtggcacttggaactgtgagagccatcccaggaccatgagaagaggtcacctgaggataaaaccaatgtgctgtggatatctgggggaaaggagggaagtccttgtgtttctacctatggtagggaagagtataaaccaactctgaaggcatctcatggcagggcagctaggcacatcaaatgcattttccttgttaactaaaccattttgaattggggtcatttttgttgttattgttattactggcagcaaaagtatcccatacactctagtagccatgttcaaaaaagtcgctttcagctcttttaccatctgtatccatagtcacgcagacacgctgagtatgctcttcagttctaattttaaaataaaatgatctgctggaaattagctcagctcatagatctccatacttacaacaccgtatctaagaattagtaaataactattaccatgataagtggcctatctcagtctatccacatgttgagtgtccaggtactggaggtggcatggaacctcccctcaataaacaaaggctatgatgagaggttatactttaaattaaattactgagtggaggcataatgtggtgagggtcacaagagaggtaccaaagatgcagcaacagagcagttgatgggcacttagcatttcagtaagtgggaatggggaggagagcaggaaaggtggaggaaatagatgaggagaggaaagaagggaagtgttctccaaggaagcacgctgcagggaaagagtctttcacctgtatgtcccacaaggcacagagtatgaactcagaaatgttgaatgatttgtctctataattaagggatgatttcactgataatgttgtcttcttccatgatctaaattcaacctgcccttcaaatccattcattcatacaattgttcatccatccatccatccatccatccatccatccatgtattcatgtattcattcatctatccatccatgtattcatccatccatcatccatgtattcatccatccatccacccatccatccatgtattcatccatccatctatccatccatccatacgcactgagttccctccatgtgccaagcactgagctaaacactaactagggttgggctttgccaatgagttcagagcctagtgagagagacagagttgtaaagaaaaaaatcacaaatgccaactcccccattgccttgcttgatccttaatgccagagtgtagcttggttgagcatgacaatcagctggagagctttttaaaaacagaaattctgcaatccttcctcttttttctttattggaaagtccaggggtgaaaggggcaaaagagtctaagtgggagttagggaggcagaagaggattgaaggcagtgtctgaaatattttcagactgagaaggaaaaggaaaacagccaagaacacaaggaggagcagtcagagcataaggaggaaactaggaaagatctaagtcatggaagccaaggaaggacattcagtaagatggaaagttcagtgtcgcaactgcagagagattcatgtccaggagaaagtcattcaaccaaccatacgcattgagaacaggtcctggatttggcaacttaaaacctcttgctgtcctctaaaaatgttgtaggagcctgacagcattaagccaaatggctcagtagttaaaaacagggaggatatgcaaagggcaatgtaggctactcatagaagaagttgagcaacaaagttagggagggagtggcagttcaaagaaaagcactaatgccacagggtgcagtggctcatgcatgtaatcccagcactttaagtcaggagttcaagaccagcctggccaacatggtgaaaccttatctctactaaaaatacaaaaattagccgggcatggtggtggacacctgcaatcccagctactcagaaggctgaggcaagagaatcacttgaatccaggaggcagaggttgcagcaagctgagattgcaccactgcactccagcctgggggacagagtgagactcctcaaaacaaaccaaccaacaaacaaacaaaaccaaaaaaacaatgaaaacaaaaatgaaaagcactaactggcttcacccacccaacatttgctgggcacttactgtacttcagaaattactagtagctagggatgcactagtgcacaagactcagccctgccctcaaggcatttacaaaccaatgaaaagaaggtttatcttatttgctcagtctgtttgaaggatgagaaaagcaggtatgtttatagacaggataaagggagccagtggagtagaggagatagagattctagagccagggcacttaaggacgttactgtctggggaagaggtagaggaaatgccatgtttcacagcacaatggtggggtcagttctggcaggaaggtgggaccccactgtctcagaaggggtgtgctgccagatggctaacaacaggctctcacaggaaaactcctgatttgaagcacttggtcatttctatggagtcaatatttccatcatgggcaactgcaaggaacccaggggagtccctgaatgcagagttgggaaaagatgtgctctaacgcatcattgccggctctagcgagttgggaggagccagctctagcacacatgggctccagaagccaaagagagaccaagaagcctggaactgttgataagaaaagagtgttcagaggaaagctgtgaagccagcatagccagctgctctcctaggcgctgagaccctgtgatgagaggagaaaccagggaggcggagttccaaatctggaaaagtggcaggcttgagtgctcttcagttactcccacttgagcaattttgctttctaaacctggttaatagcccaaaatgtgggctgcttattgtcatctcccttcactgtgtgtgtgtgtgtgtgtgtgtgtgtgtgtgtgtgcttttcctatgtaaactgctgcaccactaactctgctatactttagaactcagtaaggcaatccttagactcttatacaattccctaaagggtccccttttactctaagtcacagagaaatgttgaacatttaaacctttaaagtgcagttttgctggaagaaaatttcaagggtctccatgaatcatgtctgagccatgtattggccatgaccgcatacttcttgtcagtcttatttcatttggttgttattgtggtttggtttcatttcatgttgctttggagggtcaacctttctttcattcatgacattcaatcaacctttctccccagtgcgtcttcccattttttatgtgtgtgtcaggagatagaaaaataaacacaggtattaatgtgcctgtgggcaccagtttgtaaagcccaagacgttcttggacccaaggaaactttcagttctttctcagccttgccgttttgcatgtaaagcatttgagctgatctcagagttgaggtggctgccagcttccaccagaacaaaacacacagcagcaaaacagcgccatgtccctcagtgtgggaaccagggtctgcctggggcccccctgtaaaaacgagagatctgaaggaaaacagacagcatttgaaaggcggatgacatcaagaaagtaaaagcaactataaatatgacttctctcctgctttacactgagccttctgttcaagaaaacacatttaccagggattttttccttaagctcaactggaaaaacaaatatttagtcattttacaagagcagacaactgaaaagcaagccacagattaaacaagcattatgtatttctaagaaagttcatcaaacacaatatatctttgagaacacaatcttgaagtctgttttagaggcaaatttgaccttcaaaatgaattttgtctcgatataattacaaggtcaaatcttaaagaagcaaatgcatagacaaccatctttgcaatgagatctgttttatatttgcaaatgaacaatactggacagaaaaaaaatacataattacttctgaggttatatataaaatacccaattggcaattagctaatatcatattagcatctcaatattttagataaagcaaaactcccaagtacaaaataatctataatagaacaaaaatggcaagtcatattaaagagagattacatataagagactttattacaagttatcattttttagataaaatttattctttcagcatcactttgatacttgtaggaggcagatatagtatagagaggcagatagaggtgagaacctttcctaagaaaaatcaagcagcattaaaagcataaagaaaaaagaagaaaaaatatttcagattcccaattcgtatatcacattgttgacaaaaaaaaaattagagaataccaacaggaaaaggtttccttgtgctctttaagggtggggaatttcaaagaaccttgaactcatcatgaaaatagttctatacccatcggctttgccaaaaacactttgggatttcagtgatgggtactgagccaccaggagcaatgaaaccagcttttccatttccactgagttttgactggtttacaaggattgcacaaagatcacctcatttgtactggacacaattgggaaataaaaatttaaaaatcatccttcatatttaaaatagaaatcatgaaccccgccacaaacatgcttccccgacactcaggacctgaggttgacaacatgcctccccgttaacccatgaagcctcataggtatgcactgcatctatatagaattttccatggactccatcatcaaagcatcctttaacaagtatgaactgagcactcaccccatgcacagagctgtggacggggccatatgggacagaaaagttgcaaggtgtgtctctcactcccaaagagcccacatgccttgcaggagaggaaggctgtggacccaggttttgtgatgcagatgaaggggccacatagctgctccagtaagaagaactggaatcatctgaaggagaggaaaatagggcatttcagccttgaatagcagaacccagatcatgaaaaataggaagaacttatatggacgtcagagaggaaggcaatccagacaacaataataacttaggcaaaacagaaatcaaatgcagcttgcagaagactctgtacagggagccaacacagctactttacgtgaggagtcaatgagaccatttaatagaagccccctgtcgaaactgtaaaaatgattttgccatcttggccatctcctgagatggctgagaagggatttgccaagcaaaaaaagagttgaggggttttgcacaatggcctggaacagagaggctggagagaaatcagacaagtctctcaggcagaagttccagaaaaatgaagaagcaggagagcccgaggcaagagggaaatggcaggcacattggttggacgatgagggtttgtgtggatctcaaagggccaagacgtggggagagtctagacttttaggctaggaagtccgaaccttgttgtgaaaatagctgaagattttggagcacctgccgagcaaagtttcccaaagaggctgttgggaagattcatgaggcaggagactacagggagggaaggccagaggcagagaggccagttccaggatggctgccacgatccagcccaaggtaatgaaggtggggaagcctcggaatgcaagagacagggtggagatgagaagacatgtcagagcctggtggccaattaagcagagaaggtgcagggaagagaggagagcaggatggaaagccaggaaatgtgggtctcagtgaagatggggagttctgtttcagccccaagaatgagcatgtgcatccttgaaccccggggcctgtgaggttggtcaatggaagcccgggagctctgctcagtcagggtctaggactggtactcctgctggggccacctcagagcagaagcagggcgggagcggtggaggctggctctgaagtgttctgcccttaaagaacagcaagactttccagaggcagtgtgtagcctttaagatggagactgtgatgaagaatggagagagatggaaagagcttctcagtgacatggggagagggtccgcacctggagggcaaacccttcctggagggcagaacctcgctggccatctggcttcccacacacctgcctggtgaaccaacatatcactagggggttcttttcttgcttgaaatgtcattgagttttcaatttgtagcattcatgaggtgcattatgaggtttattcagcattttttttcttttgctgagaaaggcacaattaagtaccagaattttctttgctggcctagccttctggaatctgaacaggttttgcaatcccaggaccagatcctctctatataaaaattggtgtgggattggggggggggggtctctttttataatagctagaacatcttaatattttgtaaaaaataagctcatcacgaacccagttaacccagcaaggctactgcccttcttctgtgtcgtggtaacagctttcttcagcagtgcaaggtgcaggcagagcctttcatagttttaatcactaggtccatttattgagagagcttgaaaggtgattattcctgttctcatttctcagaaaactgaggcatgtgaagatcacaggtagggtaagcaaatgaacacaaattcaaactcggaattcaaaaccagcctctgtgtattcctgaggaccatactgtctgctaagtgtagagaaaggcacatcctggttcaacagcagagaaagcaaacaggaggcactttctgtgagtcatctccaccacagggccctctcttttgtgatccagcgatacttgttcacagtcaaagcccaggaagagtggaaagattaacctttgtgagccaaaccgtgtgacacttgattacttgacagaactaatccttctgtcctgatgacagaaattcaactacacaggtacatgcaagctaatatctgttgtaatgcctcccagtttctctggagaattccttagtttcctggacatctctgaaatgcaaagttttggcaacgagtctctgaattaacctctgaaaatctcacccagccaagatggccttcttgagaagactgaagaacatggttggtttcaggctgagctggaagtggtttacctcccaggagaggttccccacagtggtgtttaaggcatggggtggaccaacaccaggaagactcagacatcacaccacccaccttcaactcagtcacatccacctacattttctgaaaacaaaaggcagtctccccaaaaagcactgagactcttgtgtaggtaatctgagcagacaccaacttcccagggcttccttttatccaggagagcttggctgttctttttaatggtaatatcttcttcttcctgcagcaccgggctgtggcccactctggagaaaaggaaagatcattgctggcctgccttcccaatttcagacttgccagtctacaattgtgtaaactaattccttaaaatacatctcattatatctatcatccatctgaatctagatgcatacatatgtatatacacatatgtacacagttataaatatggatcaatataatgagatgtatttttaagaaattggtttatctgtctatatatatttacatacatatacatccatacatagatatctcattttatctctatatctatatacatataaacacacgtgtgtgtacatttatgtatggacataaagatgggtgtaataagatttattttaaggaacttgaaatatagagagatatctatatatatctacacacacacacacacacacacacacacgcacacagagaaagagagagagggagaaagatctatctacatccatcctgttggatctttctggagcaccctggctgacactcctgcattgatgagtcattggttgtaggatgtcctgggaacgaggcatgagcttggacagggctgtcatcatcagcaggcacttcccaaagagggctgacagctgaggcatcttccaaccatactcccagcatctgagggaataagtccttccttcctgaagggaacccagacagcacatcacagagcccacaccaactgggcaaattgaatgtgcacagagtaaattaccaaaactgccaataaaactcagaattataaaatcatataatttagaaattataaaatcatataatttagaaattacgtgatgtaattaacatttgcaatccgttgacttaaagtcgattatgtgggaaataactgagagttcgttaataagcacaaaacaatccagcagaaattgacagcattaggtgctcaggttgtgtggaggtcaatctcagcaaaccagagtcactgggctccctagatggagttaaggaaagccctgatcttggaccagccacgtcctttacacatagcaaggactgtaagcccgaccttgctctagcacaggaaggaggagggcttccctctaaaaaccacccattttctcccagaaccccaagactccagtccctgtcaggctgcagaggtgatttccaaccatctgatgccacctgcatcagaatcgctgaggcattcctgggccccatgccccattcctggagtcagcagccggactatgagactggctcagtgaaccccacagacagggtcacaggcatggaagcgcaggcagcagagtgcaggcacagaggctagcagtgaccatccacctggccctgaacaagtccaccttctcagagttttagtttcctaacctggaaaacagggaataatatcatgaaagaaacaccaggcacagcactaatgtatcacaaatgccacataagtaactgagtgcaaaatgggacatttcctgccatcggctgaggctcagaatagcacacagagcacagcagcggtgcactctctaaaaaaggatgcccgcacatccatgcacaactctctaaggagtgacctaaataacaacagcaagtccctgcccctctgccttcccggcctcaagggtatatatgtcagaaactggtcaatgctgagtatacagctcccacagtcgcagaggggagcagggtggatgtgtagagttttctggtttctgcacagtataaatcctcccacaatttcaatcaaccaaaggaggagttgggagacatctgcacaattagctcttgtgcaccggcactgatagaagagaccagagacctggcattccttcagagaaagtttcagaggctgtgcagcacctctctccaccccagggaaagaaaggaaagggggacataggcagggaaatttcacatccatgtgcagatgcaccaacctcaaggccagtgagggaagcttcaaaaaaaccatttaggctgcctccaagggttcccctagggttctgagctaccagggcacaggggctagtgactgccttccaggtagagaagtttgcagaggctgcctggggacaggtaagaaggagaggccatgggggggcacactgagcttccatccatggtgaggtgagagggcctgggtatatccttgtacccagggacccatggcaggtggctggacttgcaggggtgagccagccctgacagaaagaggctggaggtgtaccagggtgaagctaggggaagggtaccatcagcagacacacacagggatgtcaccctgccatggagagctgtggggcaatgtcactgcaagagcccttccgcaccctcccatgcattccatgaacaaggggcagcttttagacctttgcttcacagaggggaatccgacaccaaattatgatgcatggccaagtaaccccattaatagcccttgttgtcctgtcttcctgctccaaccctggagaaccagaggcagaggtcagtggtaaggagaggagtgggtgtgcaagcctctgaggctgggagccggccatggccccagaggcgtttccgatgctaacaccagctccggatgcaaagaatcttgaaacaggacgaacaataggcttttaaaaattcaacttccctggacctctcaatacttggaaattagactgttcactgtatctagaagtgacagggaaagtctggtgcctgaggagactcggaacagggacaggaaggagctatcagacttgaggcatgagtttggaggaagtaaagttgcacctacatcataacctactgagaacagctcattcagaaaacaaagaagcccagtttctcatatgttgggtgggtggccctgccaggtaaacctgtagcaaagccacatggaaataggatagtgtcaaaaccaatcaggccaagagtgagcaacagcccactgggtctctgaaagagctgaggaaacaagaggaggcaaaagaagtgatctataaggcacgaggttggtgacagggccaggaagtttacaagagcgagcatatcagatagacaaacaccaagaggcagaagagtctacagatacaaggagatccaaacctacccgcaatccccacccaaccccgccccggctttggctaccctggggctggcgaaggtattaagtgaaaacacccaggtttgagaatggctgggcatcaaggcagttttgacaacctcagaatcaggaagtatttgcctgcaggccagtagctgggagaaatgtccagctctacgtagatttctgtagctggggtcccattttccttcaaggtgggatgggtaagacagaaaacgtcccctgaaggacaagactcaggacagctccagcctagtgtctcccggtccctgtttgctccacaggagaaagaccctccagagtgcaatgaaggggcccagaggggacagtaaagggaccccatcccatgtggcgactcccatcatggcagaactgtagaatccaacatcacatggacctcattgataacactgaccacacctccttgctcttaagatggataaagggcagggacaaggggctccgttttatttgaccaatagctgcaaaagtaagaaatcgtaataagcatggaatcacagaaccagttgaatgtagaattaaacaattaaggcacatttctggcttaaagatgccaagaggtttttgtttgtattctttatgttttttttggacaaccactaaacacacattcagagcatcttctataagagccacagagacatcccttgagacttcagatgatttcaaaactctgctatcgctccttgaaaaaggcaagcctgggattgcaacctatccatgcatctaaccccccctggaaatctctggctccaagagtctaatggtgatggctgccactattagatttcctttctctctgggcattacaatcaggtttacaaggaagaaacaccacccagggttatcacctccaccagtggacacagagttcaccagcttttattgccgggactgacagatgtcaaggggatcactggattccaggattgacaggatggaacggtcagtaggacgccttcccccaacaactcagatgacagagtccacaacgcggcagccagatcaggcaggaatcccacctaatgtctgaataacaccactgataggaatccccactgaatcccaactgaaggctcagttgtacactgtgggcccaaaatacctacaacgttttacaaaacctaaagaaaaggcagatctctttggtggcaaaggcaatgtggtgagttaactttgaagcaatccaacaccatattattgtcatagacatgctcactaagaaaaaaaaaatcatacagagaaatagaaaaatagagagataaatgaataaatatttattttgaggtttcactgccaaaggctagccagagaaacaggggagatacaaggtgaagattggaatcacaactaaatattgttcctgtataaggagaattttccctgtttgaattcttagattacttgactccccgagtttctcattcctttgacaggcacccatgagtgttacactccaagcactcaccctcctatttccatgtgccagcatttccagtcactatcttgatttaagtagagaggataacagttttctcctacatagtaactttaaaatagtaacagttttctcctagaagcaacttaaaataaatttattgacattaaaaaattttaaatgaggtgtagtcaaagcttaaccagcacttttttaaaggagcatattttactttatttttatttttatttttattttgagatggtgtctccctctgttgcccaggctggagtgcagtggtgtgatctcagctcactgcaacctccacctcccagattcaagcaatccttaaagaagcatatttcataaagaacacttctgagtcacttctgttgtcttcctgagtgctttttacctgctctttgcatgtggcataaactcctgcttctctaatgcatctcagtttttaacttttggctctttcactgcaaacataggaatttttaaaataaagaaaccacagccaggcatggtggctcacgcctgtaatcccagcactttgggaggctgtggcaggtggatcacgaggtcagcagatcaagatcatcctggctaacatggtgaaaccccgtctctactaaaaatacaaaaaaattagctgggcatggcgatgggtgcctgtagtcccagctactaaggaggctgagacagaagaatcccttgaacctgggaggcagaggttgcagtgagccaagattgtgccactgcactccagcctgggtgacagagcgggactctgtctcaaaaataaataaatacataaataaataagtaaaccaaaacagttgtacaaacaccagatattcaaacatcaaatgacttgataaatgtggactttaacggggcaggggataaggaagggaaatgcagcaactggtgcatttacagcaattaatcctccctcatcattaaaaaacactgctccattttgtaaatagcagcacagagcaaccacactggagaagtcatgcttaacaatacattcatttgtgggctttgtgatttttttccctctcaagccattttgaagaaaatctttgaacacgtctcagtggcttgatgcttcacattaagctcctttaagcagctagaagtttcctgaaggaaacacatgagccttttactcctagaacgccaagagctggtggagtcctcaagaaaaaaacgacgattccagtgggaatgaatttccttctgagaagtgaagggcaaaccacattgaaaaagttgagcttcatgcctcaactcagaaagttaacctagccagggtccaggcaagaacaaaatctgccagaaaggcagggtgagctcagacagatttcaagcaggagcacaggcaaggtaatgttcaaaatcctgtccagcccccaggtactatgaatactcaatgacatcaaatggagccagttccaaattgctaaacttgtagctcatagctgggtctcctcaagaacttgtctttagacccctaaagacacctctgccacatgaagagacccgaaacgcagcttacatccagagcaagtcctttgttaatgaaaatgtgaatggcaaagacatcaaggtctctagcagtggccatatttgaacatgttttaggactttcagataaaatccgattaaaacaaacagattggggccaggcacggtggctcacgcctgtaatcccagcattttgggaggccgaggtgggcagatcacaaggtcaagagatcgagaccatcctggtcaacatggtgaaaccctgtctctactaaaaatacaaaaattagctaggcgtggtggtgcgcaccctgtagtcattctttgcagttccttgctctggggctgcatgaaggacttccacctgtgaaaagaagtggcgaatctggggcccatcattggaaatgccagccttctcactgagtctgctattttgcaagaaaaatcaccaacagcattccccttaagtaagtctctcgagatatcacccaaggcagggaatccccaactttgctcttggatcaagaagggcccccgataaggttttcaatcatccttagaaaaataggaggaaagcggaagaacagtactcttaggcgaaattaacataactgaagtcacattcttttgaaactatgtcctcagatttttgggggtggaggttaaagtgtcctttatttgctgaaatgctgatgaaattagagaatagaggttttcctcctttgttaatgccttcacgtattggcatcttgatttcctccttttaaaaaatgtactagttttggccgggcgcggtggctcacgcctgtaatcccagcccttcagggggccgaggcgggcggatcatgaggtcaggagttcgagaccatcctggctaacacggtgaaaccccgtctctactaaaaataaaaaaaaaaaaattagctgggcatggtagcgggcgcctgtggttcccagctattcgggaggctgaggcaggagaatggcgtgaacccgggaggcggagcttgcagtgagccgagatcgcaccactgcactccagcctgggcgacagagcgagactccgtcaaaaaaaaaaaaaaaaaagtactagttttatgtcttaatagcaaatctccattctaaaatgtctacaaaattatgagaattttattatatacatgaaaacatctattatggaataaataggagaaaatgtaaaatattatgtacagtatgattacaataagaaaaaataatacacaaatgtaaaatgaagatagttacacaagggtggtataattgaggcaattttgagtttttaaataattgtttaatgtccttaaagcattactttttaattaaaagaaatttcatgtgaatgttattataacagatttataatagactttttaaattacctaccaaagcataaacatttatctctacagatattacagtatgcctttccaaaaatagtcaaataaatgttagctcttctattaccagtataatgtgtacattgttagtattactgattgtgtcctgtctaagtacgaactcaactggcatatccacattaggtcctgaagaatggcctcagccttactcaaggaccgttctctgataatgtcagcttgaatagaagcaacttaaaaatctccatgcaatttctattagcctcactcatgctgctgcaagatctacaagccatttgctcttgttgggagtgtgaaatgttaaccagaaagtgtacttattatagggcgtattatttcttttcttgcttgcttctttctaactgaagattctgctctcgttccccttaaaacaatcttcagtgtttcctagatgaaatatttttctccatctgtcctctcttccagcttccacacagttgtagacttactctcttgctgaattttcagtttttcctaccaaaataccggctatttttgttctctccttccccacttctgtccactttttaaaccatcaaaaagctatctatactaccccaaatgctttcaacaccaataatacaaaattatattaaaaatgtgatcttggagtggcacagtaaccattgtcacggggtcacaaaaatcactgtttttaaaaaatggtttccctcactgaatgcccatgctgttcctggacttcactagaagtacaataaataatcttcataaagaacagtctgaaatcaccacatggtagactcgcctgagacaatcaggccttattccaattacaagcacgttgaaatgctagagaaaatctaaccaccaccaacatccaccctgcccccaagaaagaatttacatacattacacacatggccaagaacaagagaaagaaaacagaaagccccaaggtccagagtcaaagaaagaaattcagttagcaagtgctagctgaatccacaggaacccatagggatttgggtcacaagtgcaagtcctaagcactgcgggtggggttccaaggcccaagcagggacaaaggacacagcttatgacccaagagaagcaggagagcaaagactggaacctttcctagcaaaagtagctgtgtgcctaaggctacgtgcagcaaaaacagtcatctgtgagaaataaaaaccacatttctgttacttgtatggtgtgttgcagcccagatagatgatagatagatgatagaaagatagatagataatagctagatagataaatgatagatagataatagataaataatagatagatagataggagataggtacgtaggtaaataggtagatgattgatagaagtaggtaggtagataggtaggtaggtactagatacatagatgattgataagtaggtcattagacagatgattgatagatgataaatgataaatgattgataaatgatagagagagagatgatagctaggtagataaatgattgatagaagataggtagataggtagatagatagataaatgattgatggaagacaggaaagtaggtaggtaagtagactgatgactgatagatagtagataggtagatagatgatacacagaagataggcagatagataattgatagaagataggtaggtagataggtgactgatagatgattagatgtatagatagatggttgatagaaagatgatagacagatagatagataaactgattcatgaccaactgattcaacacccctagggctctggcagaagcaaaaataaaactactttatagagacactttcatagcttacattatagagaattcacaaagaaagaacaatcctcactgaagataagctcacaagaaaattttgtaaagtacatgaagaaaaaaaccaaaataagtagattttagtagatgtagtagatacaaaaagattgaggattagcaccccaaacagcatggataaaagatcaaacaaaagcatctataaagttaatttaaaatgactttttaaaaacagaaatttaaaccataataaaaagcagcagagtataaatcaataacagacagagctgaaataactgaagacaaattccagaaataaaaatttaatagactatcttaaaattagttattcaaaaatggtaagagaaattactgaactacctagaaagaaggaaaaacagagatgttaaggagtgtggaggctagcatgagatgtccaagtgaacagtgaaaatgagggataaaaattattcagaagatatatttggagataaataataaccagattttagagaaagaaatgagacttcagatttttttttaaaaaaggagtcctgagcaaaataaacataattaaatccacatctagtcatatcatgataaaacatcaaagacaaagacaaagtattaaaagtgaccagagaatagaataaagattatctacaaaggaaacaacctgatggatacaagatttctcatcagcaacaacagacgccagaagggaataaaataatgccttcaaagtgctgctggaaaataactggcaacctaaaattctacgtcaggcaaaactaacattcaagagtgagtataaattgaagaaatgttgagggaaagaccaaaagattttactacttacagacacttaattaaagagctattagagtatatcttcaataagaagaaaattaaacccagaaaggaaaaaaatgaaattcaaaatacaaaggtaaacaggctgggcgtggtggctcacgcctgtaatcccagcgcctcctgaggcagtcggatcatgaggtcagaagatcgagaccatcctggccaacatggtgaaaccccgtctctactaaaaatacaaaaaattagccgggcatggtggcgggcacctgtagtcccagctactcctgagaggctgaggcaggagaatggcatgaacccgggaggctgagcttgcagtgagcccagattgcgctgcaccactgcactccagcctgggcgacagagccagactccgtctcaaaaaaaaaatacaaaggtaaacaaagacaattatgagtggatatatatgcatcttaaattcaattttaaaagaaaattatgagttgataaatcaagataagcattgatacaattaaagagataatagtaatgattaactttagaaatcattactaaaacaaagcagaactaaagaactaggtaacagtaacctgagagctggaagtaggggagcagagtcagagggccttggatcgtttggaaagtgggtagaaacaatgcttgatgtcagactttgttaggtgagggataattagacaatcgtaagaagagtctaaccagactaaaattagagtgtataacattcccaaaacaggagattgggataggcagcataaataaatttgataaagtcaggaaaaatgaaagtcacaaaataagttgacagtaacaactacaaatatattttgtatatattgtaatttacacaatatataaattaatctcacttgtcaaaacataaatattctcagcctggatgatttttaaaaatccagttatactctgtttatgagagatgtatctaaaccataaataaacagaaaagtttaacatacatttactgaaaaagatatacctgatataacataccaaaaaagaagttcagctatcaacaaaaagaaagctggaatagccactttactatcaggacaagttagactttaggataaaattatttattagggataaagatgagcaaagcttggtaataaggagcaataattcatcaagaagatataaaactccagaagctgtgggcaccaaacaacacagcctcaaaatacatatgcaaaaatcaacagaattataaacagaaatagaaaatccttcattatagagagaggttgtcgctctcacctaaacagctagattaagtagacaagcaattagtacaatgattctcagaggatgctttgtgagacttcacctgttgcctgacatttagtggccaggacctaaagctgagggtttggaggtgtctgggaccccacattctgaattgtctgaaagaaaagtcagacaatttctttcaccctctatgcaccccacatacaggggcaccagaaccagtggggtgggagcaaaggggtgggtacaaacaatggaacagacctcaccctccagattcccacagcccatcccccatgtcttgggaggcggtttagggaggaagaagggtagaatcacgtaagatcttccatgggttttaaaattgcatatatttattgaaagtatacaacaggatgttttgaaatactcatctggatatacatagacacagcacaatgattactacacagtgatactacagtcaaacagattaacatacccatcatctcccattgtcagtgtctttcttggggacaaggggatggtaaaagaacctacaatccatgtaagagattttattagaccagatcagacttttaagtgattaaaggagactggaaagctcttgaatctactccagacagtaacaagggatgtaaaagagagatctgtccaaacgtggatgaaggcaaaggggaagaaaatttgctgaatgcaccacttatacaaagatctgaaaacacaacaatccagctagatctagcaggcattaagggaacctgaaccaaactgaaaatacatactattttcacgcccatgtggaagatttctaaaaacgacatagtaaatcccaaagaaagtatccacaaatttcaaagaatgaagatccacacaacacgctccctcaccacaataactcgacactggaaaaaaacaaaggtatctcaaaaaaaaagacttaaacttaaaaaaataaaaacaattatgaggcaatcaaagaaaattatgaaagaactaaaccaccacaaaaatcagtacgtgaactcaatctacttgtattcatatggataatctcaacaacataaccttgaatgaaaaaaccacttgcaaaaggatatgtatagaataacaccatatgtgcaaaattataaacacatttatagaatacacatgtgtgcaggtgcacatgcatatgtgtgaaatctgtgctgtatacaggcaaagagaaagcagagtcacgtgaacaggaagaaaacacacccatttctggataccaaatggaagaggaagagactgggcaagaaaaggatcaaatgaatcatgcactctgtttgtaagctgtgtttcttcaaaaagactcagaagacaatacaaccaagcattagcgtgtgttgaatttggtcaaaggcgtttttcgttttattatgactggacttttgtatatttcaaataaatagaattaaaggagaaaagttacttaaatgctccaagccatttttaacacggcttctgctcctctgagcacctggctggtgcctttagagtggcgagagatgagaggccacaagggaaggatggagggagattcaggttcacaggttctttgcaatttaacatagcaacgctgcgatcactattcaaacacacagcaagtaatggatggcacttaatatgcacttcggtttcttccactgcccttgtgcaaagtaaggcttcccagaaaacaataagaactaaaatgttttcctgaaacaatgctagattcctaaaagcaatacccaagcttgagccataatgggttcaagggtggtggatgaaacacatcttcaaggttactgttagttcactgccatgcgggcttctatgcaaacggcaacattcaccatccaagaaagtaaagagcccagactcagtctccctcttccacagatcaactgggcccaaatccatccacttctctgcattcagctctttcattagtaaacctgatactagtagtccacgtgcgcgcacgcgcgtgtgtgtgtgtgtgtgtgtgtgtttagcaagaggggcttgaattcctcaaagtctcaatgaaaactcagtgtagactgaagcaggggagattgaactgcaattgtaccagtgcttaaagacaatgaatgtttgatctgagcaatcattctgtgctgtggtgtgagaaaggaaacctacggagtaatacccctccttcctgtgaccacatgggctggactgtgcatcttggccacctctaatgcaatgcaacaccaacccacgctgtgtctctctctgtccttggcgaggtcctacacacaatgcaaggaactgcttcaccgcactggccaaggacaacaagaataggcttgaggggagattgaaaaagaggaagaaagtgtttcacacagaggagaaaagaagttttagattaaaagagccctcatcacttcccatgtgctctcaccataactgccttggagggaagcaatccctgctatccacaaaccagcaggactggcagaaggtggaacacagaggtaatcccttccaggggctcagacccaacacaagggcttcacccttggctcacttcttctcctcgtgccacgcatccaaaccctatgcagaataacacgcatgccctcatcaccgcccacctccccacctccactgcaacgtccctggtccaggccactgtcacccctcaactggattattatgttagcttcccatgttccctgcttcaaaccttgaaactactgtccacaaggcaaccagcaagatctcccgaaaacatccatcagatcacatcactcccgctgctcacaacccgccaatgctgggcttcccatcacacagacccacggcccttagggaacctggcagcaccccttcatcacgtggcccctctttctgtgacctcatctccactcctcccctctctccatctggccgccctgacctccctgctgctcctcaagctcagaaggcaactggcaaggcaactggctgttccatgtgtctggaatgttcttccccagatagctcccggctcccccttcgcctcccacaggccctcactccagtgtcagtctttccatgactgtcactctataaaatcctaacccccaacactctccatttgctgcctctgcctcatttttctctccttagcatttatttccaccacagcaggcctttgctcatttgtcttattgtctgtctgtctcctgcctgaggatggggacattcatctgtttggctccccgctgcatcctcggcacccaggacaggggtgggcacggagtgggcaggcaataggtgtttgttaatggaattctaaaagtaaatgacaaaagagaagggaggtgaaggcagatctttgttttctggtttataaacttagtgctgggcaggaggaaaaaaagcggggggttcatgtgaagctcctttcctgagtcaacatggtgatttaaaataaactaaatttagttggagaccttttaaatcatttttctcaagtcagttatatgtgctctagctcataaataggaggaagaatgcgggtgacattcccaagactgcagcaaatgtcggccaagtgaaaaacacacagaatgtcctgaagatccagcgacgtcctgaatgtgacgcgttccagttcacaaaagaggagtcacaaaatgtttacaaacctttaccatcccattgaaatggaccttcacattttcctcaaaaatagctttctaaaactgttactggtttacattaattttacctttcttctttttttcccctttttctttcttattttagaaataaagtaataggattagctttttgattaaagcatattaataaaattttgacattttatttgatttcaaaacatgttccagtttccatcattatagtgggtcctgtatgccatgtttatgttttgaaaggctgaaattatgtgtgatcaacaaatttattttatatcaagagcatctgtacatattaaatcctaaatgtgtcttgaaaaataccccctcacctttctctatcctgcattttatctgaagcattgtaagtcttcatgaaaaacagaggaaaaaatgaaacacagtaactaactaggaaccattagaattattttctttgacatttcctttttttttttttttttggagacagagtctcgctctgtcacgcaggctggagtgcagtggtgcaatctcggctcactgcaacctccgcctcctgggttcaggcgattctcctgcctcagcctcccaagtagctgggactacaggcgcctgccaccatgcctggctaattttgtatttttagtagagatggggtttcaccgtgttagccagaatggtctcgatctcctgacctcgtgatccacccaccttggcctcccaaagtgctgggattacaggcacaagccaccatgcccggccctttctttgacatttctaagcagtagatatttgcaaaccatgttaacgatctgtagatgtatattactaacaggcggggcccattgaaatcctaactcttctccatttgtttgctgattcttatcagtttaaataaaatgttcactcttaaactacattttaagcaccgcataggaagaaggtgttcatctgaggaagcagtgaacggacatcataaacttagtcaagactgtttagtaaaatcacaaatagaccaagcagtttcactgctgtgagtttaaaaaaagaaatcactgatctttagtcagacatagttttctgaacgaaagttagcacacgcggcccctttccagtctacagttgacatgtgtcttctaagtgactagactatgaaacctctaacactctcatcagagttaattcagagctagtcactaaagcacgccccctgaccacatcgtaactactgtgaaaagcagtccttatagaaatcatgacgttcttttcctttgtttgcagtaggttgttcatcgttttcatgagaacataagggccctctcccaaatagctcagtccccaaaatgcagacatcagcaaatgacagcaggtaacgcctgcagactggtgctcgccgctcactgtgaaggcaagcaggcttctgcctcagttttttccccctttctcctctgatccattccaatcaacaccactgacagtggacagactgctgtccgggtaagagtgagggggacagagggcctgaagttgctccattcgtcctcatcacgatgggtaaagaagggacttcatgtccatgtgcagttagcttccaaaagacaaggaaatctcccacctagaaggggacccccccaataccaaccacaggctgggccccccctcttcagccggcccctgcccaggtcctgctgaccaagcctcctcaggacacaaggtcagttcaggacttcagtggcctcatcccttgcatcccaccttctgagttaaagtctttcagaaatacagcaccatgggcttctagagctgcatggaaccctggagatcatcccactccactcgttgaacagtgggggaagccaaggttcagcaaacgggattcttccctcaggcttcatatgcaatggaagggcaccagctaaaagctaagcgctttgactcagagccaaagaccagggacctttctagcaccttcctcctacatataacttatatgtaggagaaacagttgtttccatgagcccatagaagaaatgtgatgtcaaagtatgggagaacgttggatagcattaatgtctagtcaatacacattctccccttgttcttacaatgaatcccaatgttgttcagggccacaatatcttcaggtacaaattacattcccaggcttccttataagatgtggccatgagagggagttgtggcctaggagatgtatgtagacatctactctgggtttctgggaaatcctgccctgctcttcctcttagggacaccctcctacctcttccatccttgggaccacgcagatgaaaccacctgcaaagttggcaggcagtggctagaaggcgactgggatggatgaatggcttccttgagcagccaccctgggaccatgcagatgaaactacctgcaaaggtggcaggcagtggctagaaggggactgggttggggacgaacggcttccttgagccctggactggtccatgattgctcaagtccaggtctctccttaggcaagacaaacacacatgtggggaggaaggccaatttatctgatcggtgagttgggaagaaaagacacagcatggtcagcgtggcctcagcagggagtccctcctttggggaaatatcctgtcccaaggccaaggtattattctggttggccattggatgagattcctgggacaggctctccctctgggggaagcccaagattgtccggctctactcagcacaaatgtgtaagtgtgtatcagaggtgaagtatcagaagtcttaggtatttaattattattaaggcaaagattacatcactgcctgagatacccaaatcccatcccaagcaatttcctaacaactgatctcataataataacaatcttattatgaaaaggccagtgcaaattgattcttagagacactattattcagtacaacaagaatcagaaagtcaccataaaaccatggatgtccagttaattcctcaccttactaaagcaaataaactgcctttagaattaaactggcaataccagtgctgccctcaaaactcactgctgcctcaccaatagataaaatgtcacatgagatgatataaaataaatggggagatgcggaattacctcactgaataaaatggttatctgaacaaaatgtcatgtgaactgacttgtcatggagcctaaaatttcttgagtcccattcccttaggtgaaggtgggaaggcatctcaaaaaatgcaagcatggggctttgaaaaagtcttcaagtaaaggaggcagtaaagcaaaaagggtagaatcatgagctttcttcagttcagagttagttctggttctggctctgacatgtactagttttgtgacctttttctaattagtagacaccatctcagaggtagctataaagattttgagatgaagtctgtaaagcatctagtatgtagaagcatagaataaatgatagctgacaattattagagtgattattatttagagtgtctggcagtggtgtgctgacaaaagggtttttgaaaaatcatttgtttggggaggaagccctggtttgtactgactgccaatttccatggtgtgaacacttccattacagtcaacttcaagctaccaatgggatgtcactgaatgcagagttgagaagagatgcatacagtcagctctcaggagctgccaagagtcagcaacagcttctctctggttcaggcactgtagtcacacctattgacatggtttggttctgtgtccccacccaaatctcatctcaatttgtaatccccacgtgtcaagggagggacctgtaaaccccacgtgtcaagaaagggaggtgattagatcatgggggcagttcccccatgctgttctcatgatagtaagttctcatgagatcagatgattttatatgtttgacagttcctccttcacacactctcctctctcctgccgccttgtgaagaaggtgcctgcttccccttccaccatgattgtaagtttcctgaggcctccccagccatgcatagctgtgagtcaattaaacctctttcctttataaattacacagtcttgggtatttctttataggagcatgagaatggactaatatacccgtcttgatcattgggattcctctgtgtacggcaaagcacctagtgaatgaatgatttatgaatgatgggttattattaacacacaaagctatttttgtctcaataattttgcatacctttgaactgagactcagaaaaaaatgttttcatgaataagaatagataagagggacattagagcatggactgttgcttatacttgaccatgaacaccgagacagtgccttcccaacacctagcactattccaggtataagatatatggcctgtaaatgacttctggtttggactggactggactgaactggactggactggattggattggattggacaaggatgcagaaagaaactgaccataagtctgctcagaaaacattcaacctctaagagggagggaagtctaccctcccccacctcatttttatcctaagcactgcctggaggaaatgccctccaagtcccatggtggaaaccatctaagatgccccttcgtccatggggcttgctctttattttaaatacagttcagttttgattgctgaaattttcttggagccaagggattccaacaatgctactactcagaacatcaagaaattccctggagattcccaaagtaaataatgtgatataactcttacctacaattaatctatgcatgaaaatatattgagggatatgacatcttctaaaattacctgcctgaatttctagcagagagacctagggagttacatcatatgctgcctctccaaacccaacctctgaatgacctccacgaagggataacataataatgcggctgtgtcttggtaaatgtcatttattccctcatgaattttgacagagatgacatcaagtttcttccaattctaagatttgatggcaccataaatatgacttcaatttttaacaatttaatgaaaaaatccttctggaaagagctgctcatggggaaacacacctcaggcatgaggcacattttcttttccagcccttcctccaaccataacagatccaaaatggacttccaggaggatcctgaaatgagcccatgtgttcagcctctcccttaaccacatggaaagggcaggcggatgacctgcccaaggttgggaattcttcacacactaaagtccatcactgacatttaggagaacattttgtttaataaatgcaaaatgttctttaaaattatatccatgctttcattgtcaagggtcttaatggatgtgtttaaagcataaataaatatagtaggcattctgcttgcttaacctttcttcctcaccccttcatctcttcatataacattcactgaacataaaacaggacaagtcctgaactcatttctattccaagtactaactcaagtcactggaaaggtttctatttcatttagatggtacagagatgtcctgctgtttctgtaccatccccatcccattgttgatatttgatatgtcatgttcatatctgttgtctttgtttcccaaagggtttgtttagagtccactgctgaagaagaactaaatggaatctgtctctgggcaggaaggtagggaaggcctttgttttcccccacagtggcaccgacccagacaacagatgacagaaggaagagaccacaggcaggacaaggccagcctggagcagcacctggcaggacgaggcttaaaagaatgaataaggggtaggcccaagcccacacgtgtcatggagtaccatttacaactttgcccacttgacaatgggaatggggagagcagagccttccagaccatcaacagtaggatcagaaagtagaagagtctggaaaagcaagactaagccagaataatctggaagaatgcagccccagtgagaagttgacagccaagcaaggagcaagaccatcctgttaagaggcactgagtggtgaaaacagccttgtcatgaaacagggcagatgatcatctcggaacgaacaggtgcattcaggaaagataaaaatgaaaacaggaagatcaggatcattaaccggtaaaacaatgcatgcccctaaaataacaactgacaaggataaagtggcacagagtgagaatcacaaagtaacgtggagcagattgactctaatagaccttttctggccccaaaagcaaaaggtttggttggtgacatcttaagacaccttaactataaggtccctaagtggacaagagcaggcaagctctctcatttggcggggaggttgggggggaacaactttaaaacagaacttaacaaaatggctaatactaactccttgagaataggattcttctagagaaaggcaatggtttgtaggtaatgtagccattctgtcaatagcatcagcaacagcactgcctcctttacaacacagacctctcagcatcaccctctgtggggcaggagacagagtgagcagaggttagtcacatccatgtgggttctagctcccctctaccactcactagcagtgtgacattgctcaagtgacaactttgtgcctctgtttcatcaactatcaaatgagaataaaattagacttacccaccagggttgctaggaaaactaagcgttaaagggcagaacccaatcctgaaaatttagcaagtactcaataagtcaaagttagtccctggataaggacctgaaacatgaagtagatgcaattcaaccagggtcatgcaaagccgggttcagtgggaagaccactgagtctgtcagacacctcacattaagccaacagtcattgtgacctaccaccatccacttccctgacttctccaagatggtgtcaatgacacactctacctgtagaccgacttccttccccatgctccagccagtccagatactaagctgaatgtacttcagagcttcagcttcataagtcaatggagtctagaattacagcccacacacctggtatccagagagccagagaagagccttgggcacatatttctccaagacatgggatgtgtttctctgagacatttcctcatcctcctcctctctattcctcttgctccctcccctcatcctcctcctctctattcctcttactccctcccctgtctcttccctcctgctcccccatttaatctcactgtgatcctagcctgcttcactctctggccttgcagctaattaaaactgtggcccttagtcatttatttaaagaccccaaaaaaatggcacaggagatctagcaatcataaaagcatcacttttctgagattctaacagggatagctcaggaggccctacacaatgtattggtgaatctattctatttcagcctaccttgcctgacactgtttatagggccagaatttattaccagccttacggcttcataaattagctagtcagctattgccacacctcagtatactgtcacatctgtgaatttatggcattgtggcttaatgtagcatcattgtcatcactttccagtacctggagcattcattttatcctggaagataattcgtcatggttattatgagaataccaacataaacaaaagaggaagaaaacatgtaggttatggtctaattgcctgaatcaatcccagaagaaaagaagatacttgacaaagtctgcagtctttgaatgaatcttgaatgtgcttagtattattcagactcgaaatgctttgcacacttgaatgggaaagtatgcagtgaaaatcccattgaaacgccacagaacgccagccaagctaaagtgctgcacttggttggaatatctgggctctgactcctccgtaaatcaacatttaaagtgttagatacagagagtccataaatcattattgcatttcttcagcataagctagtgccttcagcaagtgtcttctgctgtttggctctttgttctgatctggtttgatatggctggtgtgggtttggtttggttcgtttgtggggatgaagaggttatgcaacagaaaggcgatgacttattcttttgctcttgctcacatctcccaggacgtaaaaacaatgccaattcaaccctcctactcatgtatgacggccaaacctgacttctggcttctaactgcaaaatccccagcacactctgcaggcccgcagccagctcgtctgcttaggaaggagcaatagtgtaatttgaacatgaccaataaaaaagaacaatggtcttacttacttttacaggttacattgtctcacaggtaaggaatggaatttttaatacatttaaaaatagagattcctaaccaataaaatatccccatcaccaagattttaaggatgccatgagtagctggtattatcaatgacatttgtgtagtgggaaaagcatggattttggagaaagaaagatgcaggcctaaacgtggactctatcattcactattgcccaaggacaggctttctctccaccaggctaaatcaagtttcccagtacacaagtgtggtggggagcagagtggttccgcagcagcaggctggtaaatttagtcctaaaacaagacaggtctaaaaatcttggaaagtagaatctgtttggaagctccttctagacattctgtcaagcacagccttgttcagtaagaaggaccttagacatactttactcatggcttcccagaaaaaaagtgaaggatgatgccatcagttttcagcatttattgagagaactcgaactactggaggatttcaaagatgcttattgggtatccaagtaagacgtcaagtaaaattttggatacaggaatttgagtgtgaagggaagcccaggaatgcaactatctgggagtcatcggtgtaggtgggattggaagccatgggatgggatgagatcacttaggaagcaacagactacccccttctgtgataaataaattccagcagattagtgtagattattgtccccaactcttatgtcctacctcctttcatgcagctccacatgtcatcttgtgacttgtgcttgcctggcagtagagagcgcactttcctctccaggaaccttgggcttggccaggtgtcttgctttgaccagtaaaagtgagcaaaagtgaaagtgtgtccgttccaggtggcaacttgaagaggaatcatgcatttctgcttgccccttgccatctccccgctgccatgagagcagcatgcctcagagagctgctgtcccttcaacctgggacccagaataaaagacacagggacctccattaggcccagctgagtccgacagagctccagggacctgaagtcctctgagtgacaaacaagtggttgctgttacaaattactgagacttttggaggccatcatttgctactgcagcaaaagctgactaatacaaaaataaaacccatctcttctggcagatccccccagaaaggagggttagtctccctcatagatatcaggccaccaagcctaagagagttccagatggctatgcaagttcagcccaaggcaatatacaaaaatgctccgagtttaccactggaatttccagagtctacttagatgctcccctgagtccccactcatgcctttccagcaatgaaaacctgctccgaagaaaaaatggctgacatcgagatgactctgagtacacaaggtgcgaagttacaggagacagaggctctctcggatctccaggtaaacacacgcagctgctcaggaaggcagcctgatccaggagcctgcaggagcctgagtcctacccagatggtcaggtgcagccccagctgtcccaggacatgcacgggaggaaaggtgaccacgtgctgtcagatagcagctcaggcaccactgtgcagtgcacaaccacacaggccttcattcagcaggggactagatttgtactctttttagccaaatgtgggccttctcatgctccacgtgtaaacgtaactcaccaaacagggcccctgctgctttccgggccaagtcagtggagaggactgaaggccggctcacagctaggaaagcagggctctgccgcgccgagggaatgggtcccaggtctctttcaacatcagtaggtaacacacacactcacagcacacaccacacaccacacacactacatgctcatacatatcacacacacacacacaccccccacacatgacatacacaccacaccatacacatacatgccacacacacatgctcatacataccacacacaccacacacacaccacacatcacatacacaccataccacgcacatacacaccacgcacacatgctcatatgtaccacacacaccacacacaatcacacacacacgtcacatacacaccatatcacacacatacacatcacacgtcacatacacaccacacattacatacacaccataccacacacatacacaccacacacaccacatgctcataaataccacaccacacacaccacatgctcatacataccacacacaccacacacacatcacatacacaccataccacaaacacacacaatcacatatacaccacacatacacaccatgtgctcatacattccacacacccacaccacacatactacatgatcatatataccacacacaccatacatacaccacatgctcagccataccacaccacacacacacacacacacacacatcagcacacacacacgtcacacacattttacatacacaccacacacacacaaagcatgcacacaccacacacaccacatacacacaagaccacacacacacatcatacataaaccccacatacacaccacacacattatatatgcaccatacactcacacgcacatcatgcacacacaccacacacatcacatatacatgccacacacacacacattacatacacactaaatacacaccacatgctcataaataacacacatcacacacacacagacaccatgcatacacaccacagagcacacacataacccacacacatcacatactcaacactccacccacacaccacacaccacatacgcaccacacacacacacacacacacactgcacacacaatacacatacacataaaatttgcatgaaataaacataaaggaaatgaacaccaagattcatctctcttgccctgcatattggattgaaacatggagcagactggccaaatttaagatttttataatttacctctgaaatcttcatcaaattcaaaacacaatttcactttttgccccatccggcagtgttgggggttttgccactggaataacacagtatattttccagtcacaccgtacatcagagctcatgtgtgtgttagtttgttgcaggcgtcctggtagcagagcgtgaggtcctagactcagagtgagttcctccctccagaaatgaaacacctaagttgctcagcactgacagcaaacatgtaagtaaggcaaaggttgccaccagcccagcaggggtcgaacttaaaatgaatctgtgcatgtgggccccttgcctttgacccatggggagcatcattccataaataaacaaggcaatacctaacagccattagatttcttcaaggccatctctgcaatttctttgatgaaacaaaattgaagttcataatttcctcccaagctaatgttttacaataatttttttaaagatcccagagttacagtaatcacatatcaaataagaacattcctgagatgttttccatttggaatagtgaaattatttattaaagcatctcggccttcatccttcaggctatatgtgaagccttcaagaaaacctcctcgtgagcctaaccacatgacttggcagcccccactcctactttctagatcatccctggccatgctccaccacccatcccatgatccagcctcggcaaagccctggctgtctccacattacaccaagcacctggctgcatgctctggcatacgccacttaaactctcctccctgggaacatcacatactggggcctgtcgggggtgggtgggggacaaggggagggagagcattaggacaaatacctaatgcatgcagggcttaaaaccgagatgacggggtgataggtacagcaaaccaccatggcacatgtatacctatgtaacaaacctgcacattctgcacatgcatcccagaacttaaagtaaaacaaaaaataaaaaaactctcctccctactcatcccggcgaactcctgcctgccccttagacacagttcatgcaccagctctgctgggagacaccccttctgtggtctccatagagctcctgtccacctccgttcacagcgtagggctgggaaaaaggttctgtgatgggacgacctggatttgaatctcagcaccgctcactggctatatgaccttggacacttaaccttcctgtatctcaatgttcttgtctgtaaaactgggataatataagcactcacttgaggcaaatgtggtagggaatagatattttaataaatgtaaagcacctagaataatacttgaaacatcacagcccttatcacaatgtattaaagttttctgtttatgtggctatctcccccactagactataagcattttaaaaagaatatgccttattattttaatatccccagtatttagcaaataacctggcacatagaaaattttttgttcagaatgttgaatgaatgaataaatgtatgaaattaaaaatatatattaatattaaattcctgctatcctgtcccaaaagacaatgtgctgtcatcactgcttgaggaagaagtacattatttcacacatcaacccaccttcatcctttgagaatttttttttagagcagaaatagactctatccaaaccatatggcataaagctgtagtttttaaagataaaggtacacttcaaaaaagtgctgactcatttcatccttagatacagaatactcatcttcagcattacaggcttgtgatggaagaatacaaaattttaaaaatatataaattcacctcttagaggtaaaggtttgaagaacagagttatttggtctacttgcaccattagtttgtttttttttaattttactttaaattttgggatacatgtgcagaacacgcaggtttgttaaacaggtattcattgtaccattagtttttaagaatccttgatctttaaaatgctacccacttggcctcctcttttattcatggccttgttctccaggagagaggctgaaacatcccttagggaacattttctgtcaaggtgctagaccaggagtgtgaagcagcgagccttaaattgcaggaagccacaacagcagaaggcagaacgctcctcaaacttgaacgcagagcctggtgctgcttccaggaagtcccaagccagcctgacttctgacagttgatctcaagatctcaacctatattcattttcacatcaagactttatttttgaacaggttccaggatacaacaccagcttttttattgaaggcaaagcattctcaattacttagatacttactaattaatatgattggcgatatggtgcgtatttagaataatctgagatgaaactcattgaagcagctttaaaaagcccattacaataaaaataatacttgaagctctttttttttttttttttttttttttgagaccaagcctcactctgttgcccaggctggagtgcagtggcgtgatctcggctcactacaacctctgcctcccagttcaagcgattctcctgcctcaaactcctgagtagctgggcctacaggcgcctgctaccatttccagctaatttttgtatttttagtagagacagggtttcactatgttggccaggctggtctcaaactcctgacctcaggtgatccagtcaccttggtctcccaaagtgctgggattacaggcgtgagccacgtttggccaacactcacttttcccaaaatgtcatgataataatattcagtgtggaaggactgaattctgagtcacctgcaaaccatgatacagtctgtagcagtggtactgagtgtaatccatagaccagtgccattttgcaaaatgttgactgaccatgatgagagaagtacggaaagtaagaagggcttgtaaaattttagagcaagttgacatcactgtgacatcagtatgagctcagtgctccagttcctctaaataaggtgccgaccacttcagacactgcagcattactcacatttgggcactcattggtagggccacattacaacatgtgaccttttaaggtcagtttgtcaaggataaatcaaattatatgaaaatctgagaaaagggaagcacttattttcataacttattttcataatctgagaaaagggaagcacgttatgaaaataattaaaatttaattaattaaatgtttatggctttttaaaatttatagtttaacattactggctaaataagggaagtcaaattagtattatgtatttataacctttattgattgattgatggcctctttttggtcagaaaaacatatatcttttttgaatgtgacaatcacagtaaccaaatgatgacaaagaagttgacattgaagaaatgaaagccaaaaaattttgtattcattttacttgaaagtataatccctcatatacaaatttttatagtttatgtagccataaactacagttttgcagccataattgatagcaaagtgctaaaaacactgtaggtcacttgaacaaatgtattggcaaacaaaacaatgaaactatcaaaacttgagtagcatttacataaaaaaattttttaaataccgagaataaaaaaaaatttgcaaaaaagagtattattaaaaagacaacaaaagtagatgttgaatatttcatgtctaaaaatgaatgtcttaaggcttcctgtaaagcagcacttacattactaaaaccaaaaacaaacaaaatgaacaatcaaacaaaaatcataaaattgccaagacattaatgtaaaactacattaaagaagtctacttggaaatgttcggtgaatctgtaacccaaaaaaaggaagcttgagtaccactttttaataatatcacaaatcagtgtttttaagaatgggctgatagcatagctgtaatgacaggaaaatactgtgaaatcattattcagataacaatgaaaataaatcaacaacctgcttcttttcttcagaaagtcttgccaggaggaaaaaaaaaatcagctgaacaacatgcttagagacatagtatataaaaactaatgcattaaattcaaggtttttacatttattatgtgatattatagaagatgaacataaagaaccgtagaagcatgcaaggcttgatggctgttatggggaaagattctgacaagaatgtttgaaatgggaaatgaactcttagcgttctggtaggaaacgagttttgtcccatgtttttaaagatgtgaattagacagccagactttcttatctgtctgacatcctcagtatttgaaaatatcttaatactcctatgcaagaaagggatgtggtaattttttgatgtatatctttatataaccatgcatagaagagtctgggaatatacaaaacaaaataataagagtggctaactctggagagaaatgacaaggagttttctcttcttttttttttttttgtgaaacagggttttgctctgtcatccaggttggagtctggagtgcagtggtgtgatcttggctcactgcagccccaacctcctgggctcatgcacacctcccacctcagcctcctgagtagctggggctacaggtgcatgccaccacagctggctaattgttgtatatttttgtagagacagggttttgcgatgttgcccaggctagtctcaaattcctgagctcacagaatccactcgcctcagcctctcagagtgctggaatcagaggtgtgagccaccatacacagcctgctttttctttcttttgcttctctgtatttatagttgtttttctaccctgaatgctgcctatgtcattagaaacaaagaccacagagtcataaaagggtcacacaagttcaaccatttaaaaaacattgtcaagagctttgcccatctaagggaccacatgagcattaatgactgatgggctccatacactacccagaatgactaacacatcaatgaaagacatgatgatctaaggaccgagggaggggtcgatctaaaacacaaaatgtccctgctcaatagccacctgcacacccacagctactgcgtggagaaaagagagagctggctgcagtccccctcctgggggaaactgtgaagcacaacagagacctgctgtctggaacctggtggctccctccccacagtgagcataccacacctgcactctcatgcccccacttctctcatggaacttccctgtcccttccctccagaagctacaagctctcagaatcacacctttcgtgctccagagtcaacaaggctgagtttgtggtgggcaacaaacagactaaatcttcacaccatttctcattaaaccatccctgttcatgagatctgcattaaaacttttttctcttttgtcaagagataaagcagcagtacacagctttagaggactagggcctccccagtaaccctttcctccaaacctttctaaacaaattatcattatcattggtgccgttatcagtatactagtactgttaaagccaagagatgacctgttttaggcaataacatttacaattcaatagcagagtttcctgcacagactgtactatttacagagtcctgcagcccctggacaagggaacacaggctcccagctgcctgcttgcagagttcccctgtgggaggcagtgagatggaaacacctggatgagaggccaggagacataagctcctccatccctggttctttctccagggaagtaaactaaggcagattgcccattctctctgctcctaaaccagaggcaattttaagtggcttccagcattgatacactaggtctctatgaaaggtgcaaacctttccacactcaatggattctcatcacaaccaaagcagcagggcagtgtattagttaaaatccattttagttgcaagtgacagaagataacattgattttttaaaaacaatggtggcttaaaaacaaacaacccaactcaaaaatgggcaaaggacatgaacagacatttctccaaagaccattctatggccaatgagcacatagaaaaatactcaacatcaatgagataccacttcacactcatgaggatggccagtagaaaaaaaatatatcaagtgttgttgaggatatggagaaattggaacccttgttccatgctggtgggagcatgaaatagtacagctgctgtggaaaacagtatgacagttcttaaaagattaaatatagaattaccatgtgatccagcaattatacttctgggtatatacacaaaagaatcaaaagcaggaattcacacagatacttgtacatcaatgttcataacagtattaatcacaataaacaaaatgtggaaacaacctattcatgatcaacagatgaacaggtaaacaaaatgtagtctatacatacacgggcatattactcagccttaaaaaagaaatgaaattataatccatgttacaaaatggatggcccttgaaaacattatgcaaagtgaagtaagtcagtcacaaaagaacaaatatcatatgactccacttacatgagctacctagattaggtaagttcacagggacagaaaggagaatccaggttaccaggggctatggaaagggggaagggggaattagtgttcaacaggtaaagagttttttgggggatgatgatttttaaagttctggaaatgatgtggtgatgcttgtacaatattgcaaatgtgctcgatacccctgaattatattcttaaaaatagataaatgataaaatttatattatgtatgttttaccacagtagatttcttgttaataatggtggcttaaaccataggaaaacaagcagataggcctggtatgattatcagggacccaggttccatccattcagccacctcaacacagggcttcctctttatgatccaacatggctgctccaactccagtcatcatctcagccatgcaacagggaggtgggaggaggaaggacaagggcactcctctacctggaagttcaaccttcccttgagggatactttctggaagtggcacacagtccttccattctattggtcagaacttggtcacatagttgcacatggcttcaagggaagctgggcaatgttgactttgttctgggcacccatcttttcagctaacattgaggaagaagagacaaacaagtactgaaaacaacaaccaatcctgcataagttgaaaatcaccttgagtgcaaatgttttttagcacaggactgcacacctttatgttttcctaggatcacagtcaaaaagaagaagctttaagaaatggttctgaggactttcttctttgttaagctcactttgcaacataagaggaattcagacctcatagggatgtgagctacatagttattcaccatataccctcaggaagaagtagagctaaactgagaagcactacaaagaaaaaataaatgaagaagaacaaaaatgaagataaagggtcactttcttaatgcctcatcctatgcattttgtagaatttgaaacccctggaatggaaagcataaagctctgacaatctgggctgcattcagccttggcagaaaccaggatgtgaccactggctcattcctaatgtttcaggtgggtaacaaatatttgctttttccggggagttgaccacacaccctcttccaattccttcaactcggactgcatcttgcccttgagaaaaaagatttggcaccttcagaacacaccattccccacacttcatttcccattaaggttgtcttggttaaaaatgttgcgggccaagtacatggtttcacatactcacatggttaagagagagaataggagttctatgagtcacagaaaatttggttgaaaaaaaaaggaatcaggaagaatcagtaacactaaacgcccacacgtctcgtctctttaaagcacattgggggaaattttgcttttagtggtaactgaacattctgttgctgctatatatgtcattttcagcagagatgaaataactaacagcctgggaagatttttatagccttcccgtcctttaagggatggcgtggtcccaattttgacctcccttttactactttcctttcctttggataaaatccatgtaatcctctgtaacactagaacatctctgcattactgtgtgcacacctgatttccgtaccgttttcacccctcattttggcagcaatctatgcataaaggcaaaaagttcccacacccctatcctgacctcttggtagccgtgaccctcatcccagctcaaccctcctggcatctcctctctcctgccaggtttgtggctcaagtcaggaagcacgtcagccctgagacctgcaaaccgaatcccacagacagttctagagggtgtgcttgactttggaaacccagtttaactggcttctgcttgaatcatcactccattaacatcatcattccagaaagtcgttgctcaaggtctaaagcacttgaaaccttcccttatatttaatatttattacccatcttgaaggaacggcatctgaggacatcctcccatcttgtaacatggctcccctaagaagggtataacatagtgattgcaaagcaggactctgtagccaaccatccagatgcaaattctgattccatcacttcgcctgaatataactttggataagctgactaacctttctttgcctctacattcttatctataaaatgggcacagtaaaagtgcatcctcattaaaaaaatggtctacaagcatatgaaaagatgctcaatgtcactaatcatcagaaaaatgcagattgaaaacacaaagagatgtcacctcacacccattaggatgaacactataattttttaaaaattaaaaacaagtgttggtcaggatgtagaggaggtagaacccttatgcactgttgatgggtgatagggtttggatctgtgtctccacccaagtctcaccttgaattgtaataatccccacgtgttgtggagggacccagtgggaggtaattgaatcatgagagcaggtctttcctgtgttgttctcgtgatagtgaataagtctcacgagatttgatagttttataaaggggagttcccctgcacatgctctctctctctcgcctgctgccatgtaagatgtgactttcctcctcctttgccttccaccatgattgtgaggcctccccagccatgtggaaccatgagtcaattaaacctctttcctttataaattacccagtcttgagtatgtctttattggcagcataaaaacagactaatacagtgggattgtaaaatggtgtagcccctctggaaaacagtatggagggtcctcaaaaattaaaaccagaaatgctgtgtggtccagaaatcccacttccgtgtccatatatccaaactaactgagatagatatttgcatacccacattcttggaaggactaatcacaatagccaagaagtagaagcaacccaaatgtccatggatggatgaataaatgaaatttagaatatacataccatggaatattattcagccttaaaaagtaagaaagtcctgtcccatgttacaacatgaatgaaccttgaggacattaagctaagaaataagccagccacaaaaaaaagataaatatggtatgattctagttatataatgtatctaagggagtgaaattcatggaaacagaaaatagaatgggttaccacaggctggagaaagtagggagaggggagttattgtttgctgagtgtagagtttcagatttgcaagatggaaaatttcttcagttttgtttcagaacaatgtgaaaatacttaacactactgaactctacacttaaatatgattaagatggtaactttcatgttatgcatttctttttaccataatagaaaaaaaatcatttaaaaagtgattcttcatagagcttttgtatggattatatcagttcatgtgtgtaaagcatacaacactggatggcacgagcgagcatttctcaaatgtcatcgttatcaacgaattcacataccctgctccatgctatatcagcacacatgaattattttatgtttggttgggtgcctttttatttgtttgtatggagttttgttttcttatttatttttgccttctcaattttctgtgttttctgaggcctgttttagaagctttacacatctattttttaattattccttaccaggatgaaaataaaaagtagaaaataaatgtctgagaaaaccatcatctgcatctccttcaatttcataagatacaatttgaagtgccgaattatttcatttgttttgggttttaaaggtccttctttttactgaatgagagggatgtagattggcagcagttgatatgaaaaaaaaaaaaatcaggttgtttccaaaggcagtgtgatgggctgccctaaagctgctgcctcaaaagaaccataaggttcagatcacaaaatataatggtctcagatttcctagggcctgttctgtatataattctctaagaagaacattgataaaaaataatacgtccacaaaaataaaaccaatatgataactctaaaatacatattgtaggaaatcaggttaaaataagtagttgtattttatctgcaaaagagaagtttaaggaaatactgctttgaaataaatgaagataagtcaaatattcattcatttattcagttctgaaattattcagccactattcactgtaagatttctaggtaccattctaggtgttcctagtccccattatgagcaaaagtcgccacttcactgtgttattcgaggagggaaaagtagatacgatgatggaggcatatttgaggtcgatatgagaaagttcacgctcacaaacacagctgtgcataacgggaatggctattttatgagggagtaagttccctgtccctgggaatatgcaggaggagaaaatgtgagcattaagaatgccaagaagaaacttctaactagaccccaaatatctggtgtagataacaatcaacctctcctccaaccaaaaactcttcgagtccagttttaaggcacatcaagtggagagaacatctgtattctcagggtgacttcaggacagaatgctaagaaaatcttcactactgacttccatgttgcctgcacgaagacccaatattccattgtttttaacacagacctataatgaatctgtaacacttattctattaaaaatagtcagctccctttgcatggatgcagattgatgatccatttttagaatctcaataatgattacaatggcacagcatgtcacctggaaggtatactgtagaatccttgcctacagggtttcactgaagctttgaaaagaacatgaagataactgctaaaacttggaagcaaccaaggttccttatataggtgaatggataaacaaagtgtggcacatcaagacaatggaatattatttagcaatgaaaggaaatgagccgccaaaccacgaaaaaacacggaggaatcctgagtgcatattgctaagggaaaagtcaatatgaaaagcctacatactatatgactccaactacatgatattctagaaaaggagacagtaaaaagatcagtggtttctatgggttagtgaggaggaagagaaggatgaatagggagagcccggggcatttttagggcagtgaaacttttccatatggtactatcatagtaggatctgtttttaacatagacccatactgaatcctttctgaaaaatgtgagcctactataatagtatagcctactgtaatagtaggctcacatttgtcaaaacccataaaacatacaacaccaagagcaggccctaatgtaaactatagactttaggtgataatgatgtgccaacctagatttatcaattgtaacaaatataacacactaaaaagcaaaaacaatcaaactactctgagataccaaaaaacaccagatatatgcataaataaagaaatagtgagtaattcgataaatgaaaaagtaaccaagaggaaacttcacaggcatgattcctttaaggaaacaaagaaataagcataataataataaacttctcatttctaaaatccaaaaactgttacaaaaggattcaatgtgatatttttaaagcacaattattgagcataaaatacaatctggaaggcatataactttgcaataaccttttctgtgtttaggtaaggttgactgcagagttgagagctgggccattgacatttgaggtcatggtggcagcagtccgccactattaccacctatgtccaaacatagctgaccctagcatgactcaggttgaataatattcaggaaatgaggccttgggctagggtcccagctcttgcaatcactagttccacaatttgggggaggtgattcttctaggtctctattttcccatacaagatgatatggtttggctgtgtccccatccaaatctcatattgaattgtagttcccataatctccatgtgtcatgggagggaccagggcaggtaactgaatcatgggggtggtaccctcttgctgttctcaagatagtgagtgagttctcatgagatctaatgattttatctggggcttttccccctattgatcagcatttctccttcctgctgccatgtgaagaaggacatgtttgcttccccttctgccatgattgaaagtttcctgaggcctccccagccatgttggaactgtgagtcaattaaacgtctttccttcataaattacccattctcagttatgtacttataggagcctaagaatgaactaatacacaataaatgcacagaagaggtcagctagcagttttcacacccgtctccaggagaagagaagctaggaggagcaggagggcaaggagggtccggctcccaccaaaagagttcaccctctgggggaagggctacttattgggcttttatgcaaaattttatttgaacaaagaattcctcagctttaaaaatagtggcatctggttccttttccctgaaggtatttactcaagccaaggaatgaagcacctgtgggtgaagagcagatgaaagctggaactataaaagccggagggaagctttttctcatttctaaggagattatcaggaagaatgtactctggcccctggaaacccatccaacctctcctctcccacctgggctggctgcagcagctctgcaggatgtcacccaaaaagctccgttcccaaccctgcggcccacagcctgacaggaaaaagaactctctcaacctggattccggggccctgtactctaatagagggctggacactgcctggctgtccccctgcttagaaggaagcaaatgtttattcaaaaatatttattaggtaatacaacaaactgtcaaaaaggaagaggcgaacactgttacagtttacaaacatgaaccatggattcttaacaaatgggagactttaaatggggatggaaataaagccccaaggaggggaaagatgttgtggaaatgctgcccagtgggaggcaggcttggaaccgcacgctggtctggctggtgataatctagtctagatgaagatctggacagcatccttctgctcagccactagcctctctttgctttctagtcagtgtaaaaagcatctcaaaaccattgctttcccagacttcagtctcctgaaatgtgtgtgtgtgtgtgcatcccatatgtgtgtcattttgtgtttctgccagcctttctgttgaaacttgccagagaaaatgacccacctgcgaattggcaaacggaacctgactgaataaaaactccttgattcagagcttaagaaacaatccagtggatttcttactaatctgggtgttcaaaatagtctttctacttacttgggctcaatattttggaagctattgtggtgaaatgagtgatcacgttggaattagacactgtactactaattgtgtgtccttggaaagttacctaacatttctgagcttccatttcctcaacataaaatgaggataaaaatgtccatcatgcaagattgtcctgacaactgtgctactgtctacaggatcctaagaaagagcaactaaaattatgttaatgttattaattataattttaatcatcaatactgttaataataataaaagactttaaaataatttcctcgtttttaacttactgtaatatcaactgtctgtggtagcctgttcacttgctttgtccttagtcttgtgatccatgtctttttcttatctgttagttttatgctgtctcttcacaagttctttttctgcgtgtgtgtgtgtgtgtgtgtacacatgtgtatgtatgcaagtgtgtgttccaacaggggttcccacttgcccattagaagtttatgctggggtctagataataaaagtaagaaatccaggactacacaaatgttaactgagtggattgaagagcaagagagttctcatcacagccaaacctatgagcacaatgcattgggcatatcagagaaaacgaagatctaaggtaaggtgtgaaacacagcacatgcaactcgaaatgctgaggggaagatctggtaggggggcctggtttgtgaaactcctccgatctgggtgcgccagtccgggtgcaatgtccagctcagccacttgtccccatgggaccttgagcaagtcactccatgattccatgcctcaggttcctgctctgtgagttgggaataacagagcccctcccagtgggttgttgtgaggatttggggagttaatccaggtaaagcccagcacagtcggcattctataagcgtgagcttcatcatgatcatcttatcactttgcgtgcatctggccctcctcacttacaactactgcaccccgtggtagaatgcagcactcatccaacaagacttgcaactcacttcatctctaaaatgtaacaggtccaggtaaaaaagggcagattgaacttgtgggcttacctctagaataatatcactaaaagtagaaattcaaatggacaaagggaagaaagaagagacaacagcctgtggaagatgtttgcaaaatttggaagatggaaagcaaataagagaatggcagttgatgagtgaggggacctccctgccagaggatggggggagtcagtaaagggaaaggcaatttgcaacatacgaccctgagagctttggaaatttgaggtcactcagagggtgggagcagggcaaggaatggggctgaaaacatgagagtgtatgagtgttggagaaaggggaaattcaagtgctccctcctcctcccacatcccctttctgatcccctgcagccaggtaaccatcctgtgcctagcaggtaatttagggttcctctccagagagaaatcagggactccaggctctgcagagtgagggaatgaggcaacatactgaaaagggggaccaagtgaatggcaaggtacctcccccaggatcttccctctacttcaccctcagaaccctgcagccaggctctaacaaccccaccctcattccaccaccctttccacagctgacaacagcagtattctcccccaggagatgctgaccaacccaagagaaagagctacttagacagtcacttatgggtccccaatgacatagtcaggtgctgatacccatcacggcacacacccccagccaacaagccccacctgggcacacagtttcctagtgaattattctgaattatttcctagtgaagagcatccaaggtccaccagacacttgtgaaaaacttccaagcattagaaatgatgaccaaaatctaacaatcacgaagaaaaaatgtggagcaaaaagagatgttttaactttaaaaaaaaaaactatcattaagatcctaaagataagaacaaataatacagccattaaaaaaacagttaaagatgccttgaataaaaaggatcagagaggaggttcaacatctaaataacaagagttccaagaagagaaaacatttaaaaatggaagagaaaattctcaaagaaatcatacagaaaaatttcccacaactgaagaggcccactgagtaccccacataataaaaggaagaagaccctaaacaaggcacatctctgtgacatttcaggacactgagatgaaagagaaaaacctaaaacattcagagaagagaaatgggaaccaggatggcatcccaagcttcttgataacaacaataagagctggtagtctatgaagcatcactttcactttccaaatcgtgagggaaatgtttcttaaagggaatcaaaggcccagccaagccatcaatgtgaagaactacaccaaccatgaggctgacaggataacctggagacaggggacccagcatgaaaaccaacagaatcctagggtgccagagggcagagatgccaggacagccacgcctggaaacagccggttccatctgtgagcacagggctccttaaagcaccctcccccacaacaaaacaataaaaaccctgagagatgaccaaattcattctaacacactgaaaagaggaactggttctgccaaggagtttaagggagtcttattgtaagtacttagaaaaaccaaggcaataaaaaaatcattgaaaatcaatgaaaaatcaattgaaaatcattgaaaatcaatgaaaaatcaattgaaaatcaatgaaaagttattgtttttgaaaaaatcgaacattacagcacactatatgactcagttctaagtaacatttacatagttataataatgttacaaatgcatatcaacttaaccaacattatgatttacctacattggaaggatggagaaacaggagatgggggaagggggcatgagctaaattctcatctaccttaggagaaaattgataatgtctgatatggtttgcctgtgtctccacccaaatctcatcttaaattgtagctcccgtaacttcaacgtgttgtgggagggagccggtgggagatgattgagtcatggggtggtgtctcccacactgttcttgtggcagtgaataagtctcacaagatctgatggttttatgaggggaaacccctttcacttggctctgatctgtcttgcctgccgccatgtaagatgtgcctttcaccttctgccatgattgtgaggcctccccagccacgtggaactgtgagtccactaagcctctttttctttataaactacccagtctcaggtacatctttatcagcggtgtgaaaatggactaatacaaagtccaaatgaaaagctcatgaaaacgcagtgatgtatcaacaaggaggtaaatgacagaagaaacagctaagaggacagcagttacctctaggaaagggggctctctgggaaaatggaaggcagagaactgctatttttcattataagcgcagaaatactatttgacttttacaactatgtattagcatgagaaatataacaactagaatagaacagtgataaaacatgtagaaaatttcacagtgaataaactaacgcatacatagataggcaaccgttttctgagagtcagttgtgaacccagaaaaggcataaaatccagttcttcagagccatcccatgctcattgcatgtaccaccagtttgcttcctcccaaaattcacatgttgaaatcctaaccctcaaggtaatggcattaggagctggggggcctttgggaggtgattaggtgttgaggatggacccttcatgaatgggatcaatgcccttataaaagggaccagagagagctcccttcaccccttctaccatttgaggacacagcaagaagatgccatctatgaaccagaaaatgggccctcaacagacaacaaacctgccagtgccttgacattgaacttcccagcctccagaactatgtgaaataaagtcttgtttatgaccatccagtgtacagtattttgttatagcagcctgaatgaaccaagacactcatcatcagggctgttgcatctgccccttcccaccacagtctcactaaagcaaccggaaagaggcaccaaatacgtccccctttgttatgttagtaacacagtcatgttataatacaaaataaactaagcaatgtcaaacagatcaacataattatttagtatgacataaacctcttccaaatgcacatgcaaattttttcattatttaccttttaaaagccttaaagcttaaagtgaaaattagtgtgaaaaaaaaaacaaatttctgaaaggtaatttgtcagtctatatcaaaagattaaagatacatatctttcatcacacaattccactttcaagagcgtatctcagtctgataaactacagcatggtttgaaacagtaattttcatcttggaggcatgtgagaatactgattcctgggccccaccccaagacagcctgattcaattggcctgggataggacctgggcatctgcattctgcactcaagattgggaattcctggtttataatatagaaaactagaaacagcctgaatactcaacagaagaggactaggtagataaatttataatgacagagacatacgatggaatactagacagtttaaaagtaatgtggcattaaaaatatcattaagcatacctatgaacatgggcagatacttctaatgtgctggtaagtgaacaaaacaggtgccagcacatatatataaaagtgtatatataatatgatcccctttggggaaaaacatgtgtataagagagaaattccactatctggaatgaaatgcattacttttcaatagccattatgtctgagtgcagaaagatttaatttaaatacttttgttcatctgtatgctcacggtaaacaaagtattattgacaccatcttctaaagttcaaaaatgctgttatatatcacttgtaagttttaaacattttagtactgttcatatagatttcacctcacaccccaccctaaatccatatacacagacccactcaaactctcacctgcagattctcagagcacactacatcctgccaagtctccagcgtgaagaacaacttttgcataggtttcatctttcctttgtattaataggtaacaaagtctggctgcctcaaactcagaacatccttgcaacactgttacacccactgatcttccaagttcaccttcacaaatgtgcaagggatgagggggacaaagaccaagtcaccagcaccactcctgatcccccagattccagcccaggtaaaccattcagcatcattggtcaaaggtattgggtcactgaaggaggagaggggtagaaacaaggcattgattcaaatacttccaaaatatgtatgtgttttcccaagcagctgttactccccagcttgaggaaagtgctgagttacagatgatggagtatgaaacactgagagagggcacaccctgtgccttcgcagcaagaatggcagagctacagtggctttggtgttttacttcacccacttttatgcctactcttttcttagcgcccccttcccttactcattgcatcaaagtgatccactgaaaagaattaagtcaactgcagagttccagatagctatcctcaggagttttaaaacttaagatgaaagcagtcagggaattaagactaaatcccgaatatgtaagaaaagggctttcccacgtggcacaatacacgtactgtctgcttcacaggtccagcctggtagcaatcaggcaggataccagagcacgcaggaaatccaaaattaggttttactacctataatggaagatttacgggatggtttaattggtagtctcaggactaaaacctgaagcaggggaacaaaaacgtctatctggacacagccagtgagcccacgtgcaccccatgacactcgctcataggacacacaggcccgaggctgcaggggacagagtaaggtcacaactcctccttctcccaaccttgatgcacaccaaagccaacaacatgctatttcctgttccttttatttaagaggcaaatttgtttcttgtggtagaatgggtcttcaagctacacacacaaactcaggtgttccgcaaaacaaaagaactcattcaattcagtcctcccctgtatttccaaaccacaggggcaacactcacaagctgcaaagaggattccgccccaccgggaatgcatcggtctgcacctgtctgttgccattttcagggttagcagggccactggaaaatttcctcagtaccattttgggtcaatgtaaaggataattgaagtgcatgtttctgtaaattccacgtgctcagagagatttcaagtaaacacaggaaaataagaactgtgggcttgagccatatgttggctggccacgtggggcaggaagaacacacactgtccaggcagtgagtaactgaaaaccaagtgcccacagacaccatccactgccagaacttgggaagctggggtcccaagggacagtcccctctgctcaccctctcccctcctttctttctcaccctctcaacaaactttagtggagttggctttttttcctagaggccttcatagccactttttcccctctccaggtggtagcctgggacctactgtgcagaaggacacacaggtctgaattgaggtcaagccaggaagaggaagaagtgcagagcagggcagccactggcttctgaaatccaatggaagaggcggcaccatttagtagcatgacattctgtctgcaaaccaccatgatgatattgttactaagtagaagaatcccttttaaaagaactttcgatatattataacatactataacaagatgggaagacattttccttttaataaattgattttcttaaaggagatttcaactttccagtgatggacacttttcctggcttccacttgttttctgaaggtttccatttgggtgtgatttcttagcaaacaagagccttcccaaacattgcctgcagacatcttggtctgtagaaacaccttataaggagatcaacgtataacacagtctttttctacctagagaattagcaaagggtgaaatttggtatgacaggggtcttccctggattcctttcaatgtagtccaaggaagaactaacttaggctgaattctattaagacaaggttatcacaatatttacaagattatttatcaggattatatcaattaaatattttgggggaaaaaattgccatacaaaaatcatattaaaattgagccaagcagtgaaacaactctgaaatggcctagaaataacatgtatttgatattcactttttctgaatacagatgtgatcttcatgccatcattgaccccaggtggtaaggatcattaatgtttctagaatcctacactgggcagctgatgcctgtaatcctagcattttgaggggccaaggagggagcatctcttgagcccaggagttagagagcagcctgggcaacacagcgagaccccatctctacaaaaatattttaaaacttagccgggcatggcagcatgcacttgtagtcccagctacttgggaggctgatgtgggaggatcatttgagtgtgggagatggaggctgcagtgagctgtggtcacaccactacactccagcctcagtgacagaatgagactctgtctcagaaaaaaataaacgattttaaaaattttaaacccttaaaaataagtaaataataaattcctacactgttgtacagttaacggccccaattactaagctcaaagggaattacccagaaaaggcaagaaaaacctaagtgtgaactatggctatagagaaacaaatatatggcttgtaatataaataggtttcatatacataagagtgtaggcatacattgcaatgtatcatctcatctgaccctgctaccaaataaaccacaatgtgattttgctactgtggaatccactgtgaaacgagtcatatttcaaagaggtatttttagtgatttttaagggcaagaattcacagacttcagatctgggttccacgtgaccatgacaagcacttggtcagttctgcggcttgggctccaaattcaatgtgtggatcaccactgactcaaactaactctatctgtaagatgattcaaaagagacaatttggaaaaacagaagggaggaaagacttgagaaagagtgagcttttacaactaaacagtatttgcttgaatttaaacaccacttaaaacatagacaacaaagacaaaaagcatcagtgaaaatgtatgtcccttttacattccaaatacaggcccagaaagcaataagcaaaaggcacagctgggctctgtatagccgacttgttgatgtttaatgcaggtaccactctgatctcagcccccagatagaagcatatactctagtgatggcccaggaagacgtcgaccagcacaaagcatcaccacacttcccacattctgagttggatgcaaccattctcttagaaacctagtcttgactgggtgtggtggctcacgcctgtaatcccaacactctgagaggccaaggagggcggatcacttgaggtcaggagttcgagaccagcctagccaacaggacgaaaccctgtctctactaaaaatattaaaaaatcagctgggtatggtgaaatgcacctgtaatcccacctacttgggagactgcggcacaagaattgcttgaacccggaagatggaggctgcagtgagcaaagatggcaccactgcactccagcctgggtgacagagggagtctctgtctaaaaaaaaaaaaaaaaaagcaaaacaaacaaaaacaaaacagtcgcttctgcactcatggtaacatcctttaccatttaatctctcctagaagacagggcattgccataccattactcacttgaagatgagaagtggaggatttgttaggactgcaggtgatgaggagagactcaaacagaatgttagattctgaccgatctgctctggtttcacacacttctttcccttcctaagaatctgcttttcccttcatgtactttttcctgttttcagtatcactgggtcatttctagtaactctgcttaagtgatcctgtcagctacagggcgtgggtgggttattcagctctgcctcacagaacactcaccctccatctctgagtcagttgccttttaatggaaatactattcgctgatcatgttcataccggcccagttttgtttctcttgacaatggcccaggtgtttttctcttctgattgagttttggggtaagctcagcatctttgttgttgttgtttgttttattacatttccatttttactggaggggaaagatcagagtcaatgtgatccagctgctgcacgtcagtcccgccacatgacctgcactgttacatccaaagcgtgcagggaaaaggctgcgtgctcaggtccagaagttcataaaggcagcctctcccatcagctcaccggtggctgccagcctccatgccgccttgctctctctaggctactggtttttgcaaccttctgcttttgtccactcataactttgataagtaccgtgtcaccttctcatacgtggaaaacatgtggtcagcgattcggcatgtttaatggtgcttgaacaatacaaaggggagctgtcatccatcttttgttttctcattatcagttttcaggccacgttctaaacaaggacgacaaccaacagaacatcattccctggtgtcccagtccttgcttactttgaatctcctcaccaccttcagtcctttctaaggtcacgtacgggcatccaccgtcttttttcctaaacagaatactttgcaaagtcaagtattggcatttcgtatttaagccatgcatcctcaaggaggctaaaattagttcttgaaggatgaaaaacgtcttattccttttctgtataaagcacagatatacctaaatgtagacatacgtatatgtataatgcaaagtactaaaacagtatatctgtggtattaaattttcatgtgaggagggacaattaggaaaaaaaatcagaaaatgctttttaggaggttgatcatgaaaacaggaggttggtcatgaaaaaaaaggttgaaaaacactaatttaagcctaaatgtaactacattacaaaatgtcactacttcttgctggttttggcaccagtgcctcaggtgacacagaaatactaagttttcttttattctgatatgcttaaggtatccccaaaatgatttctctaagttgggaattgaaagggttatgttacactcattcactctttaacaagtcacatacacgtcacctcctattttagaagccaatgggtattaaagcacaagaaataaaaccactgaaaaagcaaaaaataaaaaggaaagaaataaagactcggcactctgacacagatgaagcagatgattatgtttatttaaaacagcaacttattttttaatgtctatgaactaaagatttctcaggacatcttatttcatgttaagtgtccaatgcagcaatctttgccttgcaaagcccattacaaataggcttgtgcattccagaaaggaagcatgcatttaactttcccaaatatgtaatatgcaattcttttttttaaattttttacttgcttggagcaaagactgaaagcaagtatttaatctcgcttcctttgccagtgcaaacgtaactaattctgatcctcatttccatttcttccttaatctttttaaatcagggttgggccagcatttattcccaaccttttggagaagtagcctgtatttcaaatggggccgcgatgctaccgcatgttgtcctgaccagtgccgtcctgatccttgctggagaaagaaatggaggcattttactcacaatcacagagcttacgtatgccagcattacagaatgcaaaaaataactttgcaacaatctgaaagggtaatttatggagcgtggacagtaaatggggtatgttttctgtcctgaaaatcccagatgagggcaggcttatgaataattttcaaaaatcaggaagtctgtggaaatccctactgtcttataaagattgcaccgtgctcatcgcatctcccacggcctctgcctcctcctccacctcctccgaggttccttggtcctgactcctaatggcaagggccaaagaacacaggcacctgcctccagcaaatccactccgattccccctcattcccagacacaaatttccatgaaaaccagacagaggacagaaagcaggggcaggatattccaaaagcacttcagatctgcagcctgatttcattggactcgctggcttgtttcttttagtccctgggtgtgttgactgcaggagaaacctcactaacgacgacacttcagaactgtgagtccaaacacttaaggaaggacgtgcccaggaggaaggtctagaagctcagagacagtgaggaaggggcattgctcagcgatgcttagatgccttcatgagctgactctactgggagtcacttgtcatgcccctgaatccacccacacatctctataacatatgaaaactgttcagcccaaaggaaaaaataaactcgatggttctcattaatccaagtttaactaaacacaacagtttccaagagtacatttcagccatttcgcacccgcagatacccaacctgagaagctgatgggaaacggctgttttggcatcaccgagggctgcggcaggcagcacccagggggcttctgtctcccctgtggcgctgcagctgagagccacacccatgagctgatgacgtagcgtttctctcaaaggtctcccttgatgatgtggcaaactgcaaggaccaagcacagaggcacctggacaccaacccttccctgcgagccacatggccagtcaaacgttctggttaccggggatgacacgctttttccgacaagattttaagcacttgtggcttacatcaatgtggtctcgtattcattgtgtgtttagaccacttgcctcgcacgttctcatatttacacatgttcactgaacgtaacctcaagtgaattatttaagaagccttaatgtgcttcagactgctcaaatataatttagactttaaattaaatttgtactctgatacgaaactgcaatgcttgaatgcagcttacggcatcaagtggacatgcaggaggccttggaatagaatttcagttacccctaaagggctcacacctagtggcccacgttccttataggacgaaacaagattcaactacaaaatccaactcattgcctacgtttgaaagctggggagcctgcagtacacaagataaagtcttgcttctccatttgtccttacgtgaccctacaatgaagcatcgctacacaccagagacgtataatgctagacgcgagaacacacagtcatgctccttggtcagaggttttgggtatggttgggtgttttaataaaccacaatattccttctccttcactgtttggttaccaataattgtgctgccttaggtgtaaaattcaatatggtgattagagtctagagaagccacacttattttatttagcagtttttgttttatttttacagtaagcactgcccactgggaaaaataaaccaaaataaaaagagtgaaattcccttattatgcactagcgataatgaaaacaaacttatctacaaagaaccacagacgagaaatttgcctagagaccagctactggaactaaaaacaaatttcttattcaggaaaatgtgaatgagtaagaatctgctagtgaagtttcttactttgcacaaaaaattaaatgaaatcttaactttaagagtagcataggctgggcacggtggctcagcctgtaatcccaacactttgggaggctgaggcaggaggactgcctgaactcatgagttccagaccagcctgggcaacatggcgaaaccctgtctctactaacaatacaaaaaattagccgggtatggtggtgtgcacctgtagtccctgctactcaggaggctgaagcacaagaatcgcttgaacccaggaggcggacgttgcagtgagccaagatcgcaccactgcactccagcctgcgcaacagagcaagactctgtctcaagaaataaaaattaaaaaaaaaagagtggcatagttaaaagggtagaaggttactcaatgacgcatcacgtatagtacacatatagcacactgataataacaaatggcatgtaagcactgtggattgacttcagaagacttttccataagcttcagtatcacaaacgaagggaaaagcctgtgttatgtgcaacctgtcatgatcaaatagtgtgaatatgtccttgtaaaggttaattctatagcaatacatttagttgatgtgctttcttcctctgggattctagcactttaagaatgccgttcttcaaaataatcaattgtattattctcaagaaacatgcaaaataagaaatttgtcatcaagctggaattatctttaaatagaggatattcaaatagcatttttatgcctggagttgtcgcagcatgattccggcaaaagccgcactatttgttagctggcacacagagttttggcctgaaattcagtattttattttaccctttaaaagcatgaagtgactcaacaggaaattatacatacatttttccctccaatgtaaaaactgcagatctagtaccgaacatgtcacgctggcattcaattttctattgctatcatatctggttccttagtgacataaggtcacaaaacttctactcctgtggccaagagacataatagatgttgcggttgctcattatattaaatttgaattcctaagctaaacattctagacctgcactattcggcatggtggccactagccacatgtgactatggagcccttgaaatgtgaccagcccagatggagacgtgctgtaaatatacactacacaatggattttgaagatttcatatagaaaaaaaataaagtcaaatatctcatccatattttacactgattacatttgaaatggtagtattttcagcatgtgttacataaattacattattaaaattaattccacctgtccctgtcttttttaatttggctactggaagatttaaaactacccttgaagttcatgttctatttcctttgcccagcactgccaggaccttacacggactctgcctccacgtcactcgctcccttccggtcacttccataacaggcccgccactctgaccaagataactacacacagcagagtcccatgggtggatctcagcatccgcctgcctggttctgatgctgccctggttcccactactgtgtgactccaggcaaggtgctcagcactcctgagcctcactgctattctggaaaatgaggacaattagagcacctcctgcaaagagccacagtgaagacagtcctggcaaagtgtctcctgtggctataccatctggtgagtgaatgtcacctgccaccttccacaacatcacacctctcccttcccttatgtaagactgctttcttccctacctcttaactttacacctgagatattgaagtaggtgtctggtctgatccctccaacactccagaggatttggtcagtttccacactgtgtgacccactcccaggtaacacttccaccctccaaacacaccagcaggcctgactcctccaccctcccgcccactgctatctctaccattcccgccaatccagatccaacacgccatggcacagctcaagggcctcagcctccgggtagcatgctctgatcctctgatcttcctatggaatggtgtagattgcttttggattgcatgattctattttatgttatttatactctaccttgttcccaaaaagggactcaaagtggtctacaaggatatatgcaatatgacaaggttgtttaaaattcagaagcaaaataaaaaataaagatgaagctaaagagaaacaagggtaagaacataaactcgagctaggaatgcaatggcccgccaggcaggcctcagggtctcacatatctgctggagttgggtcattcacacgtctccaaataatgaaatccaaccaaatgctcagacaatgactcctgatgctaaggctaaaaatgaaatcctccaatgattccataagaaagaaggacctgtgtgatagcaagcatgcccaagaacggccctacagcaaacccagtgtattgcacgaggctgtctccctgctcgggaacatctcctccattgccatacagtctagagccctgttcactgccatgctggcccagttcaaccaggtggtcccactgaggatgccactcttgttggtgtgtgaactcatctccttcgagatttcatgatgtgcacattcacccccgttctagatttcatgacacaagcattcaccccttttctagattctatggcaagtatgttcacccactttccagattgcacggcattcgcattcaccgcctagattctagattccacggcatgcacattcgcccactttctagattccacgatgtgaatgttcccctcctttctagactctgtggtgtgaatgtctgccccaattccatggcattcttgctcacctccctttctagattccatagcatgcggattcatcctctttctggattttgcctccctgaaggcactgtgcaagtcttctgcatagtgtcttgcatgaagtcttacacagaacataaggcaaaaacatggactaaatggacagcttgccttccaccacacagtctgtagcttctagcctcccttcctttgcacgtgcctttcccaggatccggagcaccccctctgtggatggagtcctgtatcttctcaccttgagtcaaatctgactgcccgctgatctctgcctactcagcattccctgaattctcaggcattccacttgtcctgtattaatttccacctgtaggtatttatcctaaggacaccgcatttagagtgtccttgcaagaggggatgctcctctcttcagctaaacttagctatttaaagtaaaaagggtggtagttttgtttacctgttaacacaactcatggaagagagaaaaattcaagcatgccactaattgctgcagtcagacagacaggtggataggcgggctccatagcggaatgttctggcttctcccactaaatttgcagttgttcgtctaatctctagacgtgtcccgtgtcttaacagtccctgtatgacttatgctcccacctcttgtttgggacagtgctctcatttaatagatgctcaatatattttaattaagaaatgtattttcacgttgcttaagacccataaagaacaattaatacaatgtaatgcttaattttgcaaagaaaaagtttatattgatgctaaatgcatttacaaatgtgctcgtaatgtacaaacaaatacagcccttactgtgggttacacatacttatgaaatgattttattgacttacctttggttttacaatttggctatggggtacttagaagaaactgcccttgtgggacattctgtctaatcacttatatttacaagccttagaaaactgtaaaaatatattcagtttcattaagagatattcgatcttcagaactgatactatttcatctataaaatccttttactggctgggcgcagtggctcacgcctgtaatcccagcactttggaaggacgaggcgggcagatcacctgaggtcaggagtttgagaccagcctggccaatgtggcgaaatcctgtctctactacaaaaattacccaggcctgttggcaggtgcctgtaatcccagctactcgggaggctgaggcaggagaatcatttgcacccaggcggtggaggctgcagtgagccaagaatgtgccattgcactccagcctgggcaacagagcaaggctccatctctaaataaataaatacataaataaaatccttttactttgatacctcaagtagtaatcaataatatccctctctgttctaatggcagggcctttaggtaaggtttcagaatttgggataaatactaataatatgctgatctaacatctcttctccagaagactccctagatttgatttttactgtcattatttctattttaaaactctgtagtgaagtaagttttactgtcggggtcaaatagactagaaagtacttttcaatactgaagaagcaaatttttcctccacttttgcttattctgtcctcttgctgctgtatcttgaactgcagaaaaagcaagccttgcacaaggcaagtttaaactttgtgcaattatagacccagatttgtaaatctggcagcaggctcacatcagctttgtgaggttgggtataattttaatgagaatccattcaacatatgaaatcttagaatgtttctcaattagcacttggtttcttttcaaaatgtttttacctcatttcctaataaaagaaatctcagctttctgatacatttaattaaaaagttttatgttgagattgtaaatgtgagtggtttctgtttcaaaacatttcattttgctagtacatccttcacttattatttatactctgcttagatctctgcatttcccatgcaaaaatcctgaaatgcaccttcttcagtgctgaggtctaaagtttccccttcctaagtagtgccacagtcaccccctcttcctcccacagggccctcataatagcttctttcagtccttcctctgaaccctgagacccccgttcactctcatgtcaagcagaattccaagccttcattgcacacagaggtgggtccagggaggtatcccgtgtttctgaaattcctgctttgcctgtgcctaagcttcccaattctcccaagagtcctcattttaagaacacaatgcaatgctagcattgcactagcattcagcatctcccaccatacattgcaaatggataattagcttgattgctaggagattcacctgctatcccctcttctcaccctttagcaatgtgtgtggaacgcacttggctccgaacaaattaattgtgtgtgaggggtgacatctgactacgaacaactaaaaagaaccatttaatcaggccaaattcccttcaggcttattgaggcttgagtgtggatttttaaaatgtaagcagcactgtcactgtaaccatgaaactgtcatggttttaagaagtgaagttttgggggacaacaacatgaccaacagactctacctcagcatccagttcccagattagttaatacaaacttgggccccacttttcaacagaagcacagctctaagtaaaggctggtacccagctctgccccctcaaattatttggtgaacaggccaaatgggaggaattgcaggtagtactgcagaatctgcctgccttggaaaacaggctttccatgaaatacagttttaaggtccccagaggccagggctctctccctcccctactcttcaccgcgccccccgccaacccacacgtgatgagaaaccactgcccctgcagaggccccagcagcaggcaagggtctgtggaagaaagagaggaatattacaaaggggtttctggctggaggggggttccagggagggcagagaggttcaggctccaaagctggcagcagcccctacagatggaaagctccagtgacaggacccatgaaaggacactgcagagcttgtcccatgtcattgggccatcgagacatcaagggctgcctggatttcaggaactcacatctgtagaccaagaaggaacagcacgttcccattgccaatttcaatcaatttattaaactaaggcaataggtaagtaacagatttactaagatattgggattctcttactgtccatcttagttcagatggagattcacaacaccagctaatctgattccaggatgcagcttctgacggtgcacaagctaatatttccttaagatagtcacacaaacctccctgccaggcgtgcagaaaaatgtgcacgctccaatttagtctttcttttactttccaactttaagtactttagtgagccccaagaatgcatagccactctttccacccagttagagagaaaattaatctttctaccaataacagagaatcacttaatggaaataggacgatagtacttcactaaataaggcttcgctcctttgctcccctactctcaaaactgaggttcaaatgcatttctacactttcaaatgaacatgtgggaacttttgctgaatgctgacatcaagtgaaaataagggtttcctattttttaaaagtcattctatatatgcctgttttctttcctatttcctagagagacagcttttcccccccgagtatgttttgcaggggtaataattactgcaataatgttatccttaaaagggagcacatataagacaaaagcaggtacaaaaatctcattcccactaaaacaattcaaaatcataggttaggctttaaaaggaagcaactacaaatctaggttttaaaaacctttagacacactaaagatttgtcccagatcacatctgatgtctatttctctgggataataacaaaaaaaaagaggtgataaattaattcaaatggcctattttacatacttgaaggatatttccattgtctcatatagccattctgaataggacagagtcacataatgaaacttcctttgcacattctcctgaacacgcactgagtcaagatagccaaaccccttactttcattgtaaaattactgtttctcatacgcaatcagggtctcccagattatgacatgcgaccctaaaaataggagaacttaaaagttagtttaaatctaaaacttagatccagcgctccatttttagatgcaccctttaatttcttggttttgtctacattttacttatacttaaatttagcaaagtaattttagctcaccctccttcactaccttcactagactttgcaatgttacaaacatgaagcattcaagcctctttctaatatgaaaatgttttaaataaaagataaagttaaaagggaaagatgccccttttaactttaacttttaacttttttagctatgttgaagaactggtttgggtgacagcccagccattggaaaagccattggaaaactcccgctgttgtttatttacaaaataactgctttcaatcaatcattgtgagaggtccgtacactgacaatgcataatggacaactaattaactgacccctaataagagtgtgggaaataccagggagaatgctatcatgcaaggaacagcaacaatatggaggggtggctggtcactgccaagcatgagcatccccaaataccgcagtgattttcagagttttcaaaaagccctactcacaccactgccactaagtaccataatcatcggaaactgtgccccaaagatctgaacgtccctgttacatcagcctatttttcttacaaatgttgctgctaaggttcaaattcaaggtgtagaacattaaacaatagctgtattgtgaaggaccatgctccctgggaaagcccaagtaaccttacacactggggaaggaaaaaagaactcctttgccatactcctgctctctggaaaactgctcagacgcaaggggtaaagaagcaaagaggtgacaaaaagagacctgcattcagagagatcagctgtcaacttaaactgagaagtgacctgatgcctcacagagctgggattttgccaccttgaccaaactgcttcccaggctccataagtctcattagaaacgtaggtggctctgtgtcgacaccttctcaatggagttctatgaaataacaggcatcagacatttattcactatgacaatgtcttcccaccactccagatcctatgaccgggactgacttgctatcggtttttgcctgggaataggaaacgattccagaaacattagctcttctgttttgagaagaaataaattcccccttttatttcttttttgtttaaagatagcaagataaaaataaaaactaatattacttttagaaaaaaaaagtgttgaaagtttcctattaccctacttacaatgtgagatgcatttaaaagatacataacgtataacattgtagaatagtatgtgagttacacattccttctgacgtctttcagagatgctttccttcttacttatgtatctggtattccattgggatcttaggtcttaccacaaataaaatatctgattttataagattaaaaactcaacaaggtttttctttaatataaaagcaaaacgtggaacgtggaggggggaatgtttatatacaggtgtgaatgcagcccctcacacaatcccttcaatggtaaatgctaattttctaaattttagctaaagattaaatcaccaataattcctcatgaaataacagataaacgtgaaatcatgtactacaattctactctaaatttttttaaatagaatgaagtaattataaaatgttacaaaagagaagaaactggaattataagtgctactggaattatatattccttaacaaatatcttgagacggattacccatttgctaattcagtgtactttccaaaagccattgacccaaaccgaagctaggattaccaaatggcaaatagcatttgtgatgtgtgtagctcttctaaagcctttcttgagaattgtaaaacttgatatattagccacaagtttacatagctcaccgtttctgctagaattataatttcaatggtgtaattagcttattaataatttgacacatggtgaattaatttacatggttgggttcttcgcaacgtctgttgcctgatcctcctgtggatgaaggctatgagctctggcctgccccgggagcgggcaccagccaatgccagcggagcaagggttaactttgggactgtgacagttctcccttcaggggctctaaactacttggagagaatggaaaacagtcaaaaatagtcccaaaggtaaataaactctgtgtcctatgtatgtcacccagggaagaataaaatgtatttttactcacattgaaagttttctgaactacaaaagctatagagacatgtacagagtgaaacctgtagcacatacgaatatgttattttgaaagataaaggaaactatctttagattaacgatgagttgtattaaatccacatcctcattgaaattgtttatccattttattgcgcagtgtagtctgctattaataacagaatttgtcctgtacttaaaagataattaatgcctctatgcatctatgcaacataccatagcaataaacggacgatgtatttcagacagaaaccaggtaaggctagctgataaaatacagactatattttttttaacatgccaagttttgcaattagggtggtaaactggaggcaaataaacttaacagctgcaggctgaagaatggaaaggtgaaaagactgagactgagagtgggaaaggaaagggaccgctcctggcgctgagagctggtcccagagccggtgttgcggggtgtgcgggaaggcgccgtcgggggtcattccaccatcaggacccagcggacagtgacaacccagcctcaaacctggtccctactttaggccaagcgtcagcttttttagttcaaccctgatttccactccagacaaggacaaataacctcttggtcggggccccagatgaagtccccgcggtgtgctctcctggcccttgtcaatttcggggtgccccctcctctccatccgcacccgactgcacgcgcctccctgggaccccgcactggcgagccgtccctcccggcgctggacgccccacctgtcccggcgccgtcggaagagccctgcagagtgagcccctagggccaccccgctgccttcctccccgtccccgcagccgctgtagccagcgtgggagccgggcaggtcgcgtggggcgctggacttaccgagaggttagcgccgccgtcgggggagggcgtgtcccgcacgtgtgtgtccgcgcgtgtccgcgcccgcgtgtgccagcgcgcgtgccttggccgtgcgcgccgagccgggtcgcactaactccctcggcgccgacgggctcagcccatggtgtgggcgccgggttcagggaggctccggctcccgccaatcgcggagcagggcggccgccccgacgcgcgacttgcgaacccggagtgcgcgccgggggcggggcagggacgcgtgggcgggaatgcacgcgcgtggccaggtgcgcgtgggtgcgagcgcgcgggagtcttcgagtgcgcgcgtgtccgtgtgcgcgtgggtgtgggtgtgctcgcgtgtccgtgcgcgcgccctcggggccaagagcgcgggccgcgcgggcaggtttggacactacgcgccctgctcgggtttaggacgcggctggcggctccgggaggaagaggaggaggaagaggaggaggcggaggaggaggaagaggaggagggaggcggaggagcagaggctgggacggccggaggagagagtccggccccagcaggaaaggaacccagcacgcgactactggaggggcgaggagcaagggaaggaccagaggggaggagagggggtcaggggagggaaagtgtgggagggggagccgcgggggtgcgcgctcctcctaactcggggtcgcttttagcgagaagtgatatttttccagcctcattgaaaaccgttgcaaacattgaaaatagtaaaagtgaaaacggttgcgacactaagacgtttataaaatgaccgcggactgccctcgatgctgatgagaactgggacgacgtcgcgcagagcgtccggagggagaggcgcggtgcccgggacctcggtcgtggggaggagccggatacagccgccgggacgcggggatgccgagggcaccgcggcctggtctgaccgacgcacgcggtgacagccgcccttgggagacgacggcgtctgcaaccagcagcctccaaagggtgcagccaggaggctcagcttgtccgcctccggggctcggggctaagccccttccagaagttttcgtttctacgcgaattccgaccgcaaaatccagcttacctgagcgccgctcctcttctctcatgtccctcggggg

SEQ ID NO: 1005 - DNA, 280643 bp, Homo sapiens
tttggtgtatttttgagtagtccaaagtaatttttattctctaattagtcacctcacgactttatttgaatgaattaatgagaagctaaataaactagctttttaaaaaatattttcttctctttctccaggcaatgggtcactttggggcgctgcagaacatctgtgctttccctgtgccccatcaccttcccagctcctgagctgtagccatctctgctgcacctgctgtcagagggcagctcctccggctcctgctcctgggttgcaggtgccacatctgtgcagaaggcttaggagaagcagtgagccttctaactgcagcagtcctgacaaagcactttgtgaacccctccgggacataagggcatcaaactaggaacaaaaacacagtcttgactgtgatttggtgattttaccacatacaaggcccgaaagccaattgaagacaagaaaagaagacaaatctcttgccagcaggagtaagattgtacaggagtctgagtatacatcagggcaagccaagagacagggacaaacagagagaaaaggttcatgcaattatgaatatgacctggagggggctttggaattagattacaacagtaacagagagttaatgccattttgaaacaatttaagaattatgtatttgaaggaactcagtattatcatgttatccaaaattatcccagttgctcataagacttgctaataacctggactgggggtggagggttgagggatctaatggaaaacatctgttaaaattgaatatgataatcatgtcttgtttttatgatcttgctcatgagacagtcttgaagagagaactgagtgattatccaagtaaatgtgtatttctatgaagaatgtaggtgtgtcttgactttgcattccaaaataaaaatgactgatcttttccattagcacagtttgggtcagcctaactgccagctttcatgattgtatttatttattttccctaaggagatacgggcactttgtgggccttcccaggctgctgcaaaatgatggatggttgggctccgtctaatccaaatgacacggggtgtcaggagcattggtaatcgtgtcctgccgacttcaaagcccactgccaaaacatccacagcacagaggtttggcaacttcacataatcatagcaaaaggactgcaacgtgaaaaaaacaggccctgaaacagctatgaaaagggccagttcagaaacctattcagctaagatgtttcggctagcgccttcgcacggtcaccttgtattttcaccttttgagttgccttcacctggaccaaggttggcagcatttgtgattcaaagaaaagatgcccagggaaactgactctagattatggaaataaacattgtcttcaagggatagccagcaacatcaggctcagggctagtgaatcccaagccacagtgcccaggtaactctgatgtagcaggactaaagctgtctacctagtgagagctcctgaaagagaaaccccgcagcaaatctagacgttatcccttgtttctgtaaagtgagaaattgcagctatccatgacgctttatttgccagtaataatacagtttgccttacgagtggtagcttgttcactgttcaacaaatgtattttaatcatagcaggaattaagggtgatttgtgaccaggtgctgaactagaatttctcaatgacaaccccagcttcataggcctctttccattccaggcataaatatggaggctccaatgtgaaacccggggtccttctgttccaaaaggggctagaaataaaagacaggaggggaggcaagaaggacctggagaggctgacgccatttgggtgccaaacatcctatttccttggctctcccttgcacaagttcctggacaaagtaaattataacacaaaatccacaacattcagcacatgttttcattaagcaactttagtcactaaaaaaagtgcaaatgcagactcctgtataaatctgatttgccatgctaggccaagcttattttattacatacattctgcattctaagaactaataacttcatattgtaaacattaagcatacagagttaaaattcaaggccacattatatcgattgtctcttttgtcgtgtgtctttggctggccgagatcaactcgtagtgtataaatgcataagttatataattattatataaaaagggggaaaaacattgacttgtatacttcattctgacaaacgcacagcgttcgcgactcaaaggaaaactggaggccgcctacccaaaatgcctgcgtgatttctgattgtggcagccaagaaggccatctcttacctgaccctgtggagaacaaagcccccacataatgatgaggtcctgaatgtttctcttaaatatcagacaattccagttaaaattttcatttgacaaacaaagaaagagatgcgcatttttgtttctgaattctactacttcccctttctccattacgctgtgtcctttctcctaacactgggtttggtataacactgactgcatgaaccctcgagtctccataactcattgtacacagtccccaaatgtcctgagtccagtcttcattgcttgagaagtttctttcccagccctggtctcctccttctctgcctcttcctcctccttcttcacccctctgtctacaatcacacgctcactctatacacatcctcagtcccaccttttagttcatagtcccggtaatactgtaaaggagttggaaactttgggtcatcttcacagtttgagaaagctgacagctgtccatcaaacggaatgtatttgatttcaaccaaaacagcacatgccatgcagttgcatatcaacgtctgttgatgggccacagtctctctcgtgtcttttctcttgtttttgatatgtttctatttttaaatacaggtagttttccttaaaatggcattataaacggtatgttaggtcaaaactgtgttgtttctattgctttagtttcatcccagtttgcattagtgggattccaaactctactctaaagtttatacatttcttaagaccactttctttggcactttgtccttaagacttcatgcttctacatacactgtcttttacaaggtcagtccacagatgatatgtccatattcgtgacatttttagcatcctcctcatttctgtagtaagacttcagtaactccctcccaagagtctttggatctcttccccggcttccttccccagccccagtaaagcttttttcattcctcttgaggcacttttgattcatgttctccgatagagtttgtggcgatgggctggtgaatgcacgctgatgggaaaagcctccgccaggtctttagtagtaagtgcccagatgagaaggcatatggctggtggggagcctagtgttggggtatatacccccagttggtgaattccagtatgggtttggggcagcaaaaaaactggaagatgtcacggggagggctggagggtggggcgccacaaagttcatcttctgtgggtgggcgtgataggagcccatgtacgggaggtctgaggggtacttgtacagagatgactccggggggtggggctggagggcctgggcgatcccgtggaagtcgaacttgtaggcgtagcgcttcccatggaccttggtcatgatgttcttgtcatagtagtaacggagggcgcggctgagcttatcgtagttcatgttgggtttgctcttccgctctccccagcgccgggccacctcgtcgggatccgtcatcttgaactccccgttggtgccttcccaggtgatgcagctggagttggagctgtccgacaggagctccaggaggaactgccaaagctggatctggccactgcctaatgaggtcaggagaggaaggaaaactccagtgagcacaggttccaggggaaagaggctctctgtgatgacggaaggaggtgctattggtgtgccgcccacattcccttcaccaggcctgtccgtccatccctcagctgcaggggtgcggactgctctcgttccatggccacccacttctccagagaactgcccttgcctgaacagagccgccgcctcgcccacccccaggtatcccacagctgggtggactgaacggggtaccacgggccggcccccttgcctcaaggaaagaccaactccatgacgctattcaggcttcagggctcccgtgggattgggctgaaacagcgtccagctgcaaggaggcttggaggaggccagaaacttccttagcgctgcccctgcagcacttcccattctctctctcctgagaacatgccgttaatcagtcacctgcacaagcaggcttaccccaagctctgcatcaagggaacccgacctaggacgatgatctaacagattcaagacctagatggaatgcagcgaattcatatggggcaaagttcaggctgcttccatccatttctgacgtccttaaaagaacagccagatcaacctggtgtttaggggatgaaagagctatatatttttttttcctattttgtgaagcacaaagtactgttatgtggatggcaataatgacttaatgccatttatattggctaggtcaagtaagataataaaagttagatttaggaaatgaacttctaaaagtttatggaaaaaaatcgagaatggaagtaaacaccattatttctaacataacattttgctggcgctcagaaagcaattctgtgaaaacttttcctagaacagaattaacccactcaaaatgaggaagtttaggaaaaaaaaaaaaaaagctggctctttttcaaaccagatcacccagttccagtatttgggcaagcgcatcgtaacggaaaccagtgccttgcctgtgtgctgcaacgccaattgtgttaagcagcatttccagaagaaaaaccccaacaatgagtgattgcaagtccccttgggaagctgaatgagactcttcctttgtcaaagagatcacatttagctgggtggacaaagtcagaattttcttgatttcattgaaatcatacagatacagctttgttttatgaaattcaaagaaaaatctaggcacatcattctagctgctatgttacaatacttgaagatagtttatggctccctagaagacagcagcatgtaaatattgacagcagtatccgtaccaagagaagctaagctgtgctgaacatatttcagaagcttaagaacagatgggaggtgggtctttcctcccaaattccagttacagcactgccttagacttattaccaaaagattaccttttattatagtgtaagtaatatcaatcgatgtgataaaatgattaaagtaactttaactgacatctactcagggaagtaatatactgtaaaaatcaattttacgttcattttcttctaaatcctcgctagcctcctgtacatatcacccaacttataaactctgctttgcatgttggctacatggacatggatatttttgtgaatttatccatacaatagcactgtgagaaaggtcagctttttctgaatctatgctggaaagtgctcattttcagtctagcaacacatttgaaatgtattaacagcttgtagctcattgaagtggaagcctttgctttttcagaaccacatatacaaactgttcccaatcaagttttgttgcctccaacattttattaatatgcatttagaaaatacaaagaatggtatgagaaaaccatatggtcttagtatatatattgtaaccaaaaaattacaacttgaaaaaattccgtatatgacctgggaataggaaaaggcatggatttttgatttaacagtctaacagatgcttcaatataaacacatacggttgtttgaaaataaatattcagcgtcaactttctcccatagagaaagcaactccacagacctgccgaaatcacacttggaatctactcaaaccttggcattgcctcttagcaatttgtccctcacccatttctcttataaacgtgtgtaggacagaatcagtggacaaaagtgatctcatgtctctcctatttctgaagagttagaaagcaggggacctaaatttgtggcagcaaactctatgcccaaaggatggatgagctaatttctcacttgactattttacccagtagccataaagacatagggctcaggactgtgagaatttcaagggagggtctatagaaataagagaactgtaagcaaaattcatcagctttcaaaccttgaaagaaacctggaaatgcaaaatcaatgaatgtttaagtaaatggtagaaagagtaacatcatgtcaaactcattaattgttaaatttaatatttgtaacaaaattcgctgcattttgcagtgtgtagaacaaaatttctcactgcaagaattctcaaaaatgaacaatggttgttaaaaaattgtcagtggtaaaggaattattctcagtcataaaattttaagagcaatttttaaattcttattttacttccaaaacaataacatttaatgtgtgacgaggtgcattttagaatatagaatagagatttccaaacaagaatgcttagggtttaggaaagcctaaaagtggcttgggtcactcatgggccaaaccaggatttacaaagagaagttcttgaaagacaagagctttcattgagtagcatcaccacctctaccttaggactcacctttcttgggtaaacccttcagatctattttttttttttactctctcttaataacatccttgcgatgtcagtaaggaggaactaattttttcttagggtaattaccaaaataaaacatatttggaggtaaaaaacagtggcaagcagcattgtccacctacagagaaccctgtgggtgaaagggagcggctgtggcttttaagaagacagaggcactcctttaattttacagaggaaagtaatctcctaatattgttaaaagaaagggagagaaacagggtagcaaaggggtacagactgagcaaaaaagggggaaaaaaaaactaaacggtttacaaaccacagagcaaagcagagagctgcagagtgagtcagcagctgtgtctggtggaaacagcatcctggtgcaaagccctgcagccgtcagctgatgaacaagggcagtaaatacagccgtgaggggccccaccagtaccatgtggcagtggtttggggccactttctctagaagccaggggtggtgcagaagatcccgtgtgcatggcctggaccctctgcaaggcagcaggtgtgtccagcaggtgtgtcctgaatggaagtctctgccccgaggctcagtgaggctcaggcaccacttactggaggggcaggaaagcatggtggtagggagcaccaactttggagttgccactgcttcagctgaatcctgcctctgccctttgtgggacgtttggcaactctcgcagctctctctgcctcagtatcgtcatctgtaaagtgggggtgatggtaatagtactatcttgcaagatcatggtaaggatgaactcagtacttgaatggtcttgtcagaatttctttgggctgaaaatcagagtttaaggaaagataacactcctctcctatagccaggaaatgcctaaagaaagagaaatactgttcaattggcctattgaaccatgaagaagcttgaaacggtgctattcttgggctgactgatatcctctgaaagcttactgtgtgccatgcaccattctaaacgctttacatgtattggtttatttaatccccacaggaatcatgtgattagtccattggagaagtgacgaaattggagcttagagaggtagactgacttattttgcttagcgttggcaagggttgaaatccagactctaggctgccatgcttaatcactgcgcaaacttgctttcaggcctggtttatgcacacctctgtagcctcctcaggtcctttccatgttgtcccctccctgggggactcccactggaagactgcacactgccacctcctaacaaatgggaaaacatccctagcctggtctgtcgttctgcaagaggcaggatgtattttcatgtgcaccattgaagagtatccagttagcatcaaggaagcctctgaacataacccaccaaagctctttcattagaggaaccatgttagatagattctcagctgctctgatgggatgtaaaggagctgtgttgcttataaccgatccatgatatcagaatgcagggacacactgttctcagcaggaaaagtgatgtccaaagtacacatcaagtgaatatttgggatagagatgttgggatgctgacatcatcctgtgcattcatactatatgatgcaatctttccacttaaaatgatgaaaaggaatttgtattgtatgaagagcaaagacagcaatttttaagtgatgaaagatttatttatcagagaatagaaaaatagaatcaaacaggaagaagcattgtcattaatacaaagataaaagacattctggtttcaggggaaaagttcacatgagcacaacagacacaaacctaaagatagatggagagaaagtcaaattcatcagaaactaaatgaaataaatctttatcttaaagtcacttgcctgcaaatcaaagatgggatgttgccattttctccaggcccattaagaacagtcttaatggtatgaagcacagtcctccttccccaggcctgtgatgagtttccggtctccttgctctgagctcaggtccctctatctacaaagggcatccccgggctgctgggcccagggcatatgcagtgttcccttgtgaaagctggcactttgcttaggagcaagtgactcaggccctattctacaaacaagccaagcagtacctttgggctgtgacaacgtggtcatggacatatatgtttcatttggccaatgtgtgagtgcaaaggccagtttggtcttctttggtgcagcttgactctttcctcctcttccttcctgacctcagattcatcgcctgcacctaagcagttatgaccctgaaaggaaatccttgctttctattctcacagtccgcattttgtaagacctcctcttcccttcatacttagtcagtggcagagtagggcaagaaaacaaaagtagactttgcagacagagtcaggtttctaacctgacctcccttatcattggctgtgtgacacaggaaaagttacttaacttctctggacttctaattccttttctgtaggatggagatagtaacctcccagggctgttatgagacacagaagggaccacagacattctatggggggcattctgcgggatgggagctgtttgattgttatttcacatgattgtattaacattcccagagtgtttcagcttccgtcattttcttttttctaatctatcctgaacattgctgccagatcagtcttcctgaagcatgactgataataatcatctcaaaacatagtcattatttttatttgaatggttatatggcagagttgcaaatgaaaagctgagcagaaggctgagaagagaccacagcctcaggagcctgggctactagatgaaagccagcatgagcaaaaagggcctgtggctctgtgtttgggacaatgttgtaactacctgtgtccatctctccacggaccaaaagcaccctgagctaaaggactatatctcattatccttggcattcatgtatgcaacaaataattattgagcacctagtctaggccccaggctaactagttttctttagattttcagctgtgtaaaaaaaattcattgaattcattaacattaaccaaaatttaacttcaaaaatacagatgttcaataatgataacatttcgtgttttcaatgtgtagattctcttgcagggatgtacactgattaaatcttaattattccatttcgaaccttattttggcctcaacgtttaggaaatacacattccatcttgtgcttgcaatatgcctgtaacatcttggcatttgaatttgcagttgggaatatgcagcataggctatgaatttctgaagctggtgccagcacagctggttctgatctgaatacaaacaaataaaactatgtggttggcactgaaacactaggacaggtgacaaaccttggcaatgcactggttacaaatgggctaattaagaatctgcactttcttctagcatcgaagttcagaaacagaccatcgaagatgagcctgaatttgaagtcttgtggttgtatcaaggctctcttttaaaaaatactagttattttatctgcttgtataatgggttgaattgtgttccctcaattccctatgttgaaatcttaacccgcagtatctaagaatgtgaccttttttggagataagatcctaaatgaggtaatcaagttatagtaaggttatggggtaggtattccaacctgaccaatgtccttatgcaaaagaggcatttggacacagagactgacacacacagagagatgatgatgagaagagacacgaggagatgatggctatctgtaagccagggagagcccccaggacagatccctccctcacagccctgagaaggaacgaaacctgccaccatgacactctgatttcagacttccagcctccagaactgcgagacaataaactgttgttgtttaagccacctaatccgtggtactttgttacagcagccctagaaaactattacagcttggattaggttataatgttctttgctgaagctgaaatcttaatttataacccaacccatctttccattaaggcaaataattcagtgagacctaaaactaaaatctgttcagttgaaggaatttctcaccaataccaatttacttttcaaaataaccactgccaaaaagtaattttgtaagaagaaaatcatcagcagtttctcacctggatttgcaaggcggctacttgttggtccaagaatctgataaggatctacagcaaaaagaaacaaagtcaaatcctagacatagttgtaacatagtatgatgtgacttcagacataatgcctgacttaattgttttttcagatttcagagccgaaaatgtcctccaactccaaatcaactgcctccacctcctctatgagagaagatgtcacacggcatctcagatgtcttgctaggggactcctaattggtggcagggcttggattcaaccccaggatcctgacatatagctcaaggctcacaccaaccaatgatataaagagggcaaacatgtgccaagccccatcaatccagggccgtgcaggctgtgttgtttaggcatggaaagtaaaatctaaaaaattaatggatcacaaagaagcagcctgtgtgcacgtagaatttttttccctatttattgcatagttggggacgtgttttagcaccatctcaagtcacctcgcatgagtaggctgatgacttgggccctatcttatgtatggagctgtcgaaaagaggcaaacaatcatgttaatttccattaaaaagtgaagcattttagaaatgtgctgctgagcctgaatcttctcttatggttatccagacggcccctgaaacatacctaactgaggacgctggtcttcagttttgggcactgtggaaggagatggttgagcagctgaaaatccagaaatacaaaaggcaattagctataacagatttggtcactagtctttgatgttgttgcataatcattctatcagttaatttagttattaacataatagtctaactcagaagcatctcacggtaaggaaaaattttcctttctgatgaaatcaaatgtaaacactgtaacaaaaaaagaggacatttccaattatttaaaaaatggatacctcccactttttccaaaagtaaaaaaaaaaaagaatttggaatggcttaccaaacagattacaataaatcatagtctaagataaacacataaagggaaaccaccagtcaaataaagtaaagccagggatacttttaagcatggccaagattcaggaaaacaccgattatttaatgtgtactcaaacatcccatgaaacatgcatttgtgaaggttgacatacactacatcattcctttatttttgttatgaaagtcctgatgacccaaatggagaaagaatcactgcagtgaaagatcaattgtactcttgtcgtcaatggaacaaacccatcacatgttgcaaaatcacagattaaccacagaaattattatatactccatcaacagtcatccactgcctgtgacatgaaactcagggtcatgggagccaacactgtacctttcgactggggcgtggggtggccgtgaccggtccaggctgatctcctggggggctcatatggtaaatctgtaaagacaaataaattgactaaaagatcaatcatgtaatttttataagagatgctttggttttttatttgattttgtatttattagaataaactttgtgcaaaaaaatctggtaatccaaagaaatatcccactagatttgagttttatttacaaattaaaatttcatatattatagtggtctaaaattctcacccgtttgtctgaaaacttccattggcagattctcccagagctttccaactcttctaatttcctacaaccataagtcaagaccccaataaaagtttcttacaatctagttcatcctgcttccactgggactgatctacatctgtctctttattatcttcatgactcatccaaagcagagtctacaacttggatgaaccagcccatttttgtttgaggtctgttcctaaatcaatcaaatgacattcagcttctttttcttcttgcatctcctgggaagtgatcgctgccttatctttttatttgccagctgcctctcttagccaactcccattttccctttataatctcatcaatttatattaaatcagtcttatctgatctagtgattttcataggcaaatgtctcccatttctaatgttctaaataaatttagaatttctctaaaatgacctgcatgaaatgaattacaggactgaaatagtattgctcccacagcccattaatgatgaccttctgagcttaagcatatgccaaacatttctttgtatttataaagtcgtatcacttgtcctataaaccttcatttacttttcatatgcaaatttaataactatacttctgcatcctcagtgtgagttctattaatgattatcaaagctctatgtcatttcaagtttgtttcaaaaatatattacagaaaccttattataatactcttgctaagagtgcatagctaaggctatttctacatgcaatcttattacataactgtttcaaaattatgtcttcttggattgcttggtctcagttcaatgtcatgtgtcattctgggccaagtgaaggccatggccaaatatctcagcaggtactttgctgccagacaccaggagatgtgtacaaaatttcacttggagggtaggacaatgcaattgtttttaagcttctctttaaacaaatattttaattttgtttaaaaccagcaatttgatgggtcaatcttcaaagagcttgactgtgttgcagaagatgtgtctcttcctattttcatatcccaaagagaatagaaatgatgcgcaacgtgaaagtcaacacagaatctccttaatgtatttggtctgtttggctgcaagcatctttgctactagtgtggtctatgaaatcctacccttcagagctttggagaattagataatttttctttttaaactgatgttactcctctctctcagctggcatttttgcatttttggacgtaaatcttttcccacccagatcctcagattttcacatctcttgtgttggggttacacataggaattatatctgcagcccctaacaatttacaactgaacttcaacttaagtctctgggaacactctgcacatgggttctcagtcagttgcattttgtctaaaataaactggacagccagagtttcaatttgcaaattgtctcagaaagaaaaacctactcacaaggcaatcctagccacatctaacctaatttaggagcagaaaagcacattaactaaggccttctatttaccaaatgaaaaaaagcaagataatacagaaatacagaaatatgttctagatctctgtttctcaaagggtggtctgtggaccagcaacatcaacaatacctggtagcttgctagaaatgcagaatcttaccccagacctactgcatcaaaatcagcattttgtttattatctttttttttttttggaggtggagtctcgctctgtcccccaggctggagtgcagtggcgcgatctcggctcactgcaagctccacctcccaggttcacaccattctcctgcctcagcctcctgagtagctgggactacaggtgcctgccaccatgcctggctaatttttcgtatttttagtagagacagggtctcatgctgttagccaggatggtctcgctctcctgaccccgtgatccgcccgcctcagcctcctaaagtgctgggattacaggcgtgagccaccgcgcctggcctcagaatcagcattttaacaagatcctgggtgactctggtgcacactgaagtctgagaaagcctgctctagaccattgctcttttcaggaactctgttcctgcagatgatttcagaaatgctatctagagtgtgcaaagacaaactaaaaaatggttgaaagagttctagatggattgcttttacccatggcataagtatgctaatggaatgaatagacagcatcagtaggttagtcagatactaccttaaacataaaattgttgctcatgaaatgtgactgggaaaaaaaataaatgccgaactactattcccaaaatattttgaaactctttattcacaaaatccttcatatggtgtataaccatatcccatcctccctcgaaaataagtcgaaacttaacaccaaacagtctacttttcagccaagtatttgagacagttatatgaacaatgattcacatgttcataaacatattgccgcggaagataagtgggcttttgttttcttccatgacattctggtccaatgcttccttatcggctaccgatcacatgctgtgggcactaagtatccccctgtgggatatgacattgggaaacattcaactcaggctcactgagatgggggacagccaggggtgacttctttggcagctacaccatctcaaaaccttcgtagttctgctcttgactgcttgaaaaatcactcctctatgtatctttgctatgtgtcctttattgataatagagcatcagacttccaataagaatatattttacatttaattttcgctgatcatttcaacaccctctccatttctctttgactttgatcttcaaggcaatgaactcatatgcttggcagaagtgcccatgtaagggaaggctgctttctggcactggttctgttgttttatctgtaagagactgtgtttaaaaactgagctttatagaagtcattgcataggcagcttgggtgaacacagatgtacattacatcacaacagtataaaaaacagcatgaagctacaaatagggactcggctagtgctgaccactacacaccagcaactgtgtcgatttcctgggagctgggatcagcttctcattctgaatgagactcctcctccaccacacccttttgaagacatcactaaattaatacaacattctggctaccctttcctggagggctaagttcagccaagttttacattctcccttcatcaaactcactgaggaggaacgctctagctcttgccccacacaccccacaccgccaccccgctgcctacccgctttattttttaaagggcaagaatgtggatcgtggaagagctcatcctcattctgcaggatccacaccatatctgcaaagcaactctggaggttccctggctgggctggatgggaacagatgagatttgcctgctcttgaaattagatgctaatggggaacacaaattaggaagagcaagagctgctgctaagaaccaatctagaagtgtctgtgaaatgaaaaaaaaagtttgagtcaaccttaacataattaagttgctctctattttcctccagatcttcttaaaattctacatcaaagtttgagcatggagttttggaaacattttgcattcccttcttgcctaggtttgcatatccctgtggttatataagaactaagcggaagcaaagaatgcaattttagccatttgctaagatacaggctttacataacacctaactgagagatgctatgcagtagttgtattgtctcactatgcctagctgtgctgaaaagcactaggctgtgagctccaatggaggaataatttaagattccaagaaacccctgaagagcagcagcttcaaagtagaagcaaaggctgcatttgcaggcttaactctctaatctcttttgataacaccccagaggcatatcataatatatgggttgtcatggggatggaagaggaaaggatggggttgcagaacatcatccttgggatagaactgagcttttgcatgacctgctcctaagaggacaggcagggtggtgcactgtgtagttaataggggcttgcaagattctgtggatctgtttttgccactttttcccctgagacctcaaagggctatggctccaaaagaagtggattcagcaaaaaagaagggtgtttgtagaggaggtacagaaagggattctggtcgtagtaactgcaacaacgtgagaaacacgtgaaacatcataaaataaagtataataaaatatatatatatttaaaaaatcataaaaccacagaatgtaaaatgatatgcctatgggttgatactttatgagagtagagaagactgtctcaatgctaattcaacaaaggggttgtgaaagaaggtaaatcttgaatcaggaaaacgtgggaaaatactaggtacgggcatgcaaggaaaagggatgaggtttggacaaatggcaggtagtggtggtggcagggcatgttcacatgtggtcccctgtgaggtcagtgaacggcctcggccaattgtgcagggagactgaactgacacagcagcagcgagactgacctgacagggaagcagtcagggggctctggaataaatgatccacttgggaaggtgggccatgaacagaagaaaaggtagattgggggctgggcatggtggttcacgcctgtaatcccagcactttgggaggcagaggtgggcggatcacgaggtcaagagatcaagaccatcctgaccaatatggtgaaaccctatctctactaaaaatacaaaaattagctgggcatgatggcatgcgcctgtagccccagctactcgggaggctgaggcagaagaatcacttgaactcgggaggcagaggttgtggtgagccgagattgcaccactgcacttcagcctggcaacagagtgagactccatctcaaaaaaaaaaaaaaaaaaaaaagaagagaaaagaagataaaagaaaagaaaaggtaggttggggcagtaacccagggatgggtgactcacagtgggaagggaaggagggaagggtggtgaggaagtgctgggaaggtggatgcagcaggacaacacacatgtgtaggagtctctgcagaaagggtgcggaatgctgtctaatttaaccagtaaaccctgaacaccactgtctcctctatcagggactctataatgaaacggccaccatgcagagaagagacagattctggtctaagtagagttgttacctaggagcctggcttgcttcatggtcagcacaataacgctgaccagagttcggttccctcggatgtgggattagacaaagggtatggaaatgaagatcatggcacagcaaaccaagagtggaggagacagggatttgggtctgtatccccaaggaccttcaaagaaacagtcaacaatcacctttctgaaagtagtcaggtacccactgaccacagggatatcgtcagattcccagtgacctccctctggagctcgttcagctctgaaagttagtgatgcaaaagctcttccccctcagccatcacgacgttcattctccagttgcaggttcacagcttttatctccacaggagcagtcctttaaggttgatcgcttagcaatggatgacccgaggtgtataactagttcttatctccaagttcaagtccctgaatagggcctacagtaaatagtcctctggcttgttcagtctgctttaaattctttacaggtcagataccaatatttgtattggttctcataatcacagtagcagtggtcaaaacaggttatttcaggtacaaactgagtcgcgaaaacatacttgactagtagtggagctgtggaagtgtgctctctcccaggtcacgctcaaattatgggcccatggaagaccaccatcagagcggcatgggaggtgtctgagtttgccacccttgccttccctgggttgggcagagagggagtcccaaccaacatcctcacagtcaccctcttctccatccacctggatgggccataccttccaaatccaccatatcctaaaatgtgaaaacaaagcagctccaggacccactgtcttaaccaggtagcatcagtcagctggcttgtctgacagagagattgtgccaatgaatttggccagtgttgtgatcttttaacacagtttataatactagctcacaacccctggctttgcaactcagtcagaggcacctatgagatgtcttaacataaacaaacaaatacaaaattaaaaagtaaaaaaatttttaaaaccctagccaaatgttttggaaatagtttttatttttttagtttatatggaaatattttttaaatgctcacagaattacaaaatctctaaagcttgagtcaaacatgaatttctattttccactcgcaatacacgtggtggatgtctttaggaccaatcttgcagactctaggcactgggtcttgcccatgtttcaatggcctgtgaaatcttttacatgacagagatgacttactacctcttagtaccccttagctgctaagcctttccatcatgcttcccaggagcaagacagtaaactttttctctgacgttagagaagagaaaattgccagcctgaagtcactaggcagtaaccagggcagtgtcagtatttgaacagcctgagaagcttcctcattcattctctttagctccctgggcccccagtctttctcattagaaagaaagagtagttgccaagcctagatcttgaaccagttcgaactgagacttgtgtattccggatatgtgatagagtttaacatgaattctggaagcatgtatgaatatggagaaaccatcccaccaccctgaacacaatgtcatcagctgtgaggctggtacaatgatacctagcttatcgggctgatgtaagtcccagggagaggacaaatgctaaaggcaagctatacccttctgggaaatgccctctctccctgctcattattcgtctggcaaacatctaattcccctttgccatgtggccattcctctggaaagcatctttatgcctttcatgggggattgagttcctccccacccctgctcctacgccctgtattgctagaagtggttcctctaccataaaatctatcacattagggaaaacatttatgtgtacatatgtgtctctctggctctaggtcactctactgaaacatctagaactggaggcaaaacatttcggtttgttcaccatcataccatccgtggctggcacagaggaggcactcagcaaatgaacaaaccaagctgaatgaagaagtaaactttctgaagacaggaagcttactgaagcctggttcatctatatattcccagagtctaacaccacgcttggcactaatgggcacttgatagatgtttatttttgcatgaatggcatgtaaatttattacctaattaaatcatttggaggacaggcagtaagattcagatgtaaatactactggttgcatgcttctgctctgcaagactggcttcttgtgacatactgataatcggtcactgtgaatctggggagtgtccttgttttgtgctcttcccccgaggagggacagatccttctgttagttcaaaagtcggcctattcctaactgccaggcatccaggatgccttctttgcccatctgtctttctgaaaagctagttaaagggctaatctgctcttaattcctttagtgtggtctttgaatgaaatggtttgagtggatttagtctccaaatcaacagaggcagaataagactgtctgggactggcttcagctccgggatcagctctctttgtatcacgtgacttagggcacggatctcagcaggacatctgggatgtctctcaatgaagagatcacacaggggtgttttcgtacctggcctagttgtaattctttgcgtagcttcaggatatactgaagtatttgggaaaataaaagctgcaccccctgcagacaaaaggaaagacaaacatgtgaaggtcttttgttgtggttgtcgatctcaacatcagcgccaaatctacttttccctatgacaacaaagggaagagacctcctcaaacctgccttaacagagctccggagaaacagacaggtgcacctgtcagattctcaagatggaagtgaaacttggagccttggtgtactcctgtgccccgtttgctataaagcgttttgtgttttgattttataacttcttgatgaagccctatctgtgtccccctcaatcccacttcccactgggcaatctcgttttattaaaaaattatatggtacatgttttatttttcaacttgtataaaaacccataatatattttacagagcttttggaaagtagtatcaagcaattataagtatttagcctaagagtatatggattttattaataattaatccacatctctattcaaatgcattttccctctctctcttttgaccaaaactcatgctgttagctgagaaaattcccttttcatagttcagtccatttggaatttgttgtcttgttcattggtttcttccgtgtttaacaatagcaaaatttaatatatttggagcttttttgaaactttcactcaatggttaaagaactcataaataaatgtgaaattatcagaaaatgtgcatagctcaaaggtgtttcctaagaaggggaagtaacttcctctaagttatctgttatttctggccacaaggtcactaataggctgatgtgtgcaaccaaaattattgaaaaagtgtactaccaactcgaagcaggttttttaaaacttcagattaaaaagacaatgtgttgaatatagaagaccatgataaatgagcaatttcattgtaatactcaaaccgggactcactcacattttatattttaaaataaaatggtaaatattgggaaaattgcgtatttctatgtgagggctgatcgtgagttaactggctgacttgcaaggctttctggcacttcccgtctccctccctagcccgagtgattgtggagggtccctgcagctaacagagtggggtgagcagccggtggccatgcttccggaactctctccatcaggaaggagcagatggatgtgaaccaggaacacattcatccacagaaaacccagcctctgctgtgagcggggggcgagggaggaaggttagccaggatgaggcacggtgttaaaccctacttaggctcaggcaaaataaatacataactaagtcaaatgtagaggcaacggttagagatagaaaacaggcatttggttagtgactaatttcatattctccaaaattatagcagaggttccctctgaacaaaagctctcaaaatgttacagaaattccctcctgccttttgcaaacatacaaagtctgtaggaaaacaaatcaaatagcctaaaagtttattggaaaggaaaaagaaaattccaacttatcctagcaaatatttctttaagaataaaaatggaaaaaattaaaggaggttgctaagggcccttttatatcgaacatgcttttagtgtctacagagtcagcacagcgaatatattgggaccaacagaagaagactgtaatccggcaaatgtgagctaagttatggctaaaggcaaattctgcacgtctcctggttaaaaaggaaccctttgataatcaaagtggggtgcttgggaagcgctcagaaaaccaaagggcttcaccttcctttaggctgtggtacattcctaagtatccgaaagtattctgaatcatctacctgcgttctgtcttcctggcacgcgctgactggtttcccatgaaagcatgcaacctgtacgtaagaccctacgctcttgctgggaggcaggggcggggccagcattacctgtgtttctagcatgcattaaccgtggagagttttgtaaggctttatcaacatcatctgaagtcaaatgtggaagaggagctacaaaacaaaacaaaaagcgacatcaaaatgaaaaaaaaaagagagagagagaaagagaattacctttcttacaaaaaaaaaaaaaaaaaaagaaagaaaaagaaagaaagaaaaccgttcccccactcccacactaacatcatgggaagcttataactatttccagcaacctgctacttgttagcatgttaaaacctacatgggggcccgtctttaattcagggaagaagtggttgggatgccaggcaaagcaatggaggagaatttatccacctcactgtctgtcacactacttccttctcaccatgctggacgttgtagaaattaaagcatgcagcaaacattctggattcatgccaacatgccatccctttctgtcaggttaagccgaatcacatgatacaaagtgaaaacttcccttgttctgtgctcaggttagaatataaagtggggcttcatgtagctttagggagaataatccccctaattcctacgaaagagaagccttaatgattctatttcgattcggggtatcatggagacttaactaatgtgtgaccagttaacgcttcctttcccctttgacattccatcttcttggtcgcaggaccctggaggaggcagctgagtgttgaagtgaattttggcttctcctgagagcgctgactacttctcatcaggtgatgtggccagggtgttgctcccctaagtcatcacataccaagcatgtggctccctcggatccccagtgggaactgggcgagggcaggaggatgctgtcgacacacctggttgaaccctctgaagctcaggtcataagaaccatagccacagccatctatccttggaggaagggggagcttactctctctgaggtagtggagatgtgagagaaggatgtcggcgttgtagctgggggtgagcctctggaagtcgtccttggtcatcttgcacagttccttcccatcgatgttctggaataacaagatgttgacgtctggaaggccatattctttcaccgcccactccagccactgccgcacatggtctgtactccatagcgtaggatctgaaaggggtgggaacacattcagtcaattcctgaagccagggatcttcatcttggggtagatccccatccacgtgggatttctgaccagctgccttccacaagcacagcctccagccagcctccctggctacccaggagaacattttgggggaaagacaaaagctgcctcacatccatagatcattgtctttaaagtgaatagttctggaatcttgggattattcacatcacatgcccttgtttttgctcaatctaaagtttcctgtaggcataagattttaaaaattcttttttctcatttatgttcaattttatttatttattttaaaatgagtaagaataagaggaaacttcttttccttagaaaactactggtatatttatatatatttatatggaaataagagtaagccacacatatcaggaaggtgctaattacagatcacaacaacaacaaaaataataataacagtatttatgcaaaatactgaaaaatactgaccacagaatcggaaatgaaatatagatacaccaagactctagcccctcctatgagccagcgttcctcatagagagctgtcagttccagacttttcctgcagggtgtttggttttgcaattaaccagcacctgcaggagtggggttggtgagtggtttttgcattccacagctggccatggcgagcacaaacaccccacaggatgcaggccacgtcgtcacactccagtgctacctatgggacagggagagcagggcccgggggagaaggagcaggtgatctccaacagaaacgccagccgggatgtcctgtggtaaacaccctcagtggtagggtcttcagagtgtggtaaatggggcggctgctcccttgggccccgagccctgagagacacatgggcagggagttggagccctgagttctaatctcaccatttctccactttctggaccttgctgtgggcagctatttctcctttctgtgtctgtcccacctgtaaactaagagcactgatctcagttcccgggacaagcccttaggggtcaggcatgccaggatgttccagtcctcttgaatgaaagtcaggtgtgggagtcacattttagctaatactttcagatccttgtttgtttggtcccactaatattttaggctactcaagaatggagcatgtagtatgctgctgcaatacatttttaggtttgcagaggtaaaccgtaataatagtgagaaacagccagccagtcatacacccagagttctcttcctctccctccttccctcttccttccttcgcttctccctccctttcttcccttcagctacatagaagaaagaaattattgcaggtccagtagaatctacctttcccattccattctcctactgcaaacacctatcctgaagttagtagctagtggttagaagtaaccactatcctgaagttagtacgtgtatcactcctatacatattttaatatttttaccatttaaactacatatattgttttgtgtttttaaagttaacataaacgatatatgatttgctattggcactcaatgttataatttcaagatgtagccaaatgaattcacaaagatatactcaatcattaagcagctcttaggcctcccccatgtgaataatctcaatttatttagtgaatgtcccctgtccatctccatgcatacgcgtgaatgagtccgcattggtccagggcctggggtcctttctggaatcatctggggagactgaaaaactagtgatgcctggtctcccctgggagagtctgcttcaattaggctggagggcagttgggcatcacagttgataacagctcccccaggtgactctaatgagcagccaaggttcagatcatcttccctgggcctcactattccaagcgtggtcctccaaccgcggaagcatcagcatcacctgggagctaattagaaatgctgagtctcaggccccacccagacctgctgaaccagaatctacattttcacatgaaacctggggacacgctggccttggctgagtacctagatacgggatttctgagttacagggcacatccatcttcaacttgaccagctagcattggatgtctaccaatatttaaacacccacattctcacttaaaaatcagtgcacaggccaggcgcggtggctcacgcctgtaatcccagcactttgggaggccgaggcgggtggatcacgaggtcaggagatcgagaccatcctggctaacacagtgaaaccttgtctctactaaaaatacaaaaaaaaattagtcgggcatggtggcgggtgcctgtagtctcagctacttgggaggctgaggcaggaaaatggcatgaacccgggaggtggagcttgcagtgagccaagatcaggccactgcactccagcctgagcgacagagcgagactccatctcaaaaaaaaaaaaaaaaaaaaatcatcagtgcgcagaacctgaaaactaaagggaactctggttttgctacagagagaatatcaacaaaaactccaacggcagtgatgacagaaaagtgtacatatttatttgtcatccaaacacttggaaacatgttgttagtctgtgaaaactgaatgtagatatggaaggttaatgttatccagttcactgaagttcagatgactcttcgtcattggctgagaatttggctttcagagataaaatgtttcttttttcatgacatgtcagaattcctctttctacaaaaatggatcatactgaggtcttagggcaagttctctttacctttggttctgtgcagaggatagtttgttcagccctcacagagagaagaccccccatcctacccaagtcattccctgtaagttccatcctttgatgttagcgaaacccacctttttgttttgttttgctttgcttttaacaaaatgggaggactattttttttttaatgtaacaactgtacttcctagaaataagttcattctgggaacagactttcttctctaaatggtggaaccggatattctcaaaatgacacataaacatattgtctgaaagccactaggttcgtgttaaaatggtgaaaggagaagtttaatctctctattatcccttggtgtgccccttaattggtttcgctcatcaagacaagggttatcctggcccattcagttttcctttaagggaatcaggtgcaagaccccagagacaaagtcctcaacctgtattgtacttatctctacaagtctcactttgagttggtaaaaggctgttctggagttccggagttctgccaatatgagtataaattactacagcctttctgatgaacaacacaataatacaacaatacaacacaacaatacaatcaaacgtctttaaatatgtgcagattccctggcttaaaaattccatttctagaaatttatcctaaggaaataatagaggatgtgcgcaatgatttattgtcaaggatgttctttgtagtgttgtttataatagcaaaacattggaaacaccctaaatgtccagcaaaagagaagcagttttgtaatgcatttaggaatgttcctgtgatatttagagactaaaaattacactgttgaaatatatttattgatatgataaaatgttcaaagtagattgcattttaaagtttcaaaatattattatgatatcattgtattttgcaaagatatataaatatctgcacagaaagaaattcagagggagatacagcaaaacgtgaactgttgtcactgagggaaaggagatggggaattttagatttgtcattttcactaaactatattttctcatttttctataataaatatggaatacttgggttacaaattatttatacaaaatgtattctctatttttcaaagccaaaacatggtcttacaaaaggtatatatatatttaatgtatattatatgtatactatatatcacctatatataatatatgtgaaagtatttttataaaatactttaaatactttataaaaagtattttttaaaagtataaaaaataaaagtaaaaaaacaaaaagaaaagttaaaaaaatgaaactatgcaaagcattttataaaaagtataaaaaataaaactactaaaatactttataaaaatatttttataaaataataaaatatataatatatatagaatatatacttacatatatgctatatatactacctatatatagtatatatgtgaaagtatttttataaaattgctgtcaagagtataaaaagttaagtttcagtttcttttatattttgttaatatagactgcttcatctgaaaagagtaaaattacatgaagtcagaacactcccacatccttttagcatttgatctccacacctctgccctataaatttctaagcaaacaatggtgaaaacaaaacatggccactcggtagaagaaatgagggcattccttttctcctgagcactcgcaccactctcccagacccactccggaggtgttgcaatagaggacagtttgcaggggaaaaacccagattccccagcatgaagcacacagtcctttgttccatgggtgtcattcccaaccattccccctccaccctacatttcctgagccaatgcctccatgcctgtgccacatgccacccacagcgtgaaggactagcaccttcttgtgccctcacctacactcacgacctcctttgggcatctgtcctagatgttctcacagaggaaacacttaacaaatctctgggcagtgaagtgataacaagactgaagacctagtctctgctcacactgaactccacctccactactttggccaggcaatgatgctgcagctgtagatgatggtttttagagttcaggtcagtgcactgggtccaggctgtcaggttttggtcctaaccttttaactccatgaagagccccagtagtctctctagtctcctccacactccatggtatctcagcaaagctttatggcttctgtcacaccaggaatcaaagaaaggggctcatgagttcctatgagattcagcaggcctgtcttcctcctttcttgaccccaaccacacatgtgtaggaggaaggggaggggactacagcataagccccagccgaggcatcacctttgcctatgtttaggtgcgaccttctgccctaggtaggaacacctcttgtctccaggtagcagtgtgtttggaacctgtcatttaattttataactggacctcatttttctcttctgtaaaacaatgtggagaatttcaggacctgagaaatgactcgaataggataagaactaagatagatttaattcaagtaaaagtcattaagcattatgcatatggctatatgcaccagtactatggagattccaaagtgtccaagaccaagagaaacactaaggacccactgagagaggcagcttatgaccacaaccacaaagcagaactaagtctctgtgatcaggctgggcgtggtggctcatacctgtaatcccagcactttgggaggccaaggcgggtggatcacctgaggtgaagggtttgagaccagcctgaccaacatggagaaacctcatctctactaaaaatacaaaattagccgggtgtggtggcgcatgcctgtaatgccagctactcaggaggctgaggcaggagaattgcttgaatccaggaggcagaggttgcgataagccgagattgcgccattgcactccagaagcctgggcaacaagagcgaaactccgtctcataaaaaaaaaaaaaaaaaaaaaaagactccgtgatccaaggaggaagtggaagtgcagagaggtagcaccaaccaggaaaaatgggaaaggcttaccaggagagtgaacttggattaacagcgaggattttgacagaagtagagagaagctctttggtttaggggaaccacttagcccagcctcatccgacatgggcatgaaatatctgacatgtttaagaaaaagggagaaatttggtgtggctgcagtggaggatttcagagagagcacagcaacatacgaggatggggatgaaagctgggctcagatcaacaaggtccttgagtcttgctaacaaggttggattttcatttttagagatttcagagtaattgaaaatttctaagaaatttttaaaaatcttaaataacaccaatcacagaaaacttggtgatgaaaataaaaggctttattgggaatccaaatacccacattgggattcttattcaaccatttactggacgtaaacgtcaacctctctggaatttgttttatatttttctgtgggtaattaaatgaaatgttaggggaatagaaaagtaaatgagataatggatgtgaaagcactttgccaacaataacatactgcaaaaaaagaatgcatccacacactcgattttgcattgcaaactctgctaaaatggaataagaacaaaatctgttatcacaggggcagcctcctccttaagacacaaaagtccaatttataattttattttaagaaacttttggagatgcttctgtcagatgaatcataagccattgaagataagttgttcattttcagccttccattccaattgttttgaaaacatctgtgtcatcattctacatgtcatggacaccaaaatggtaaactgtcatggcacaggctaaacagaagccatcactctctgaagcctcttatttgtatcttaagttacatggttattatgaaatctactttggtaaattggaatttaaaaaacaaataaaagtaaaccattacacacagagttctggagttgtactgttaatgtactctgtatgtggagtgggagtgggggtataagcagtgggagggagggaggaaggctgacatttaaaaaaaatatttccatgaaacaggattctgacctagtagagttcccctgttgccaggaaaatattgagtagatatttaaatcaggcaaaggggcactgcatcgccaaagacaaactgtgcctttgtgaaacaaaatgcctcacacaggcaaacatcttctttcagaggcccctctagagaaatgaataaagtaagattaaataaaagccaaactggtgataatgaaagtcctgaatgttatttttcttaaataatatcaacgtaaaatattggcttcccaaaagaaaaaaattactcttggttatgaaaaaaacatcaaaaaataaaaactaaaatgtacctctaagccatatcacaagcctagtgaggtgtttgtttataaatccaggccctgggcaagtcagccaatctgctgtccaagacactcataagcctgcaaaaataagatttaacatcttgcatcctcaggaggacagaagttacatttataaagcaggcccaatagagagaactggcttaaatttgagcaatgattcactccatcacaaatggaaatttgatctcaaataaagagcctacctcaagactgtttctgagccttttaaatttctaacttatatgtagagttcatttattgttttggtattgatttctaattttattgcacgttggccagtgaatagagtctgtatgaaattaacattttattttattttatttttttgagatagtgtctcgctctgtcacctaggctggagagcagtggcatgatctgggctcactgcaacctctgcctcccaggttcaactgcctcagcctcccgaataggtgggattacaggcacccaccaccatcgtggctaatttttgtatttttaatagagatggggtttcaccatgttgtccaggctgatctggaactcctgaccttaggtgatccacccacctcggcctcccaaagtgctgggattgcaggcgtgagccaccatgcccagctgaaattagctttttaaaaagttccggtttgttactcttttggcggcctagtgcatggtcagtttttataaatgttccttgattgcttaagaaatgcatattctctaatttgggagtacagagttctagaaaaaaaactcttggtaaggtgtatttaattttaatgtcactgacctatcaattactgagaaatgcaaattaaaatatctcactaaattggacttgactatttctttttgcagttcattacatatttcaaggctatgttattaggtacatgtaagtttatcattattatatatttgtcatgaatttagccttttttcactatgtaatgaccctcaattatctccagttatgctttctgcctgaaagtatatttagtctgctttctatttctatttttgtcagctttttaaaaattcaattttcactagcgtatcttattctgtcaactctcaatctttgtttgtgcaagatttttttgtaaacaacccataactgattgtggagtattttttagtctagtctatcactctctgtctttaatggcaaatttggtctatctacacttattatcactgatctatctgatttttaccatcttattttgtgctttatgttaaactttcttagtccattctctatttctccttgccaagtgtctaatcagattgatctacttttcttcattcacttttttttctttgtttctgtattggttttgctctttgacattctagttctctttcctgttaatctttaaacaaaatctaagtttaattaccagtaatttagaaagcttatacttgaatcatccatctctgattttacatgacaatgttccctcatatttttactccactgaattttctactccctacttagggaggctgtggttgtcattttacagccatttctttctagatctaccctcaccttaatcaatttcattgctcccatttccttcctgtatctcactcccttcttctaggatccattttttaaattaaatcttttgttattatctgaagtgaggttcaattagcaacaaactctctttttaactccttcttttatgttcttccttaatatttaaaaagtttatttattttatactctttatccaatactttaattatttaaccttctgcttaatcatgttcattgtttctgttaaatcttggttgggggagatctctcttcagctatttttttgtaatttgcgggtggcagagtcatctttagcgggtctctatctgcaggaattctgtacagcgtaggttgaagacatgtctctccatgaagatttcgtatttacttctgccaggtttcccagattatcactagcccatgaccatttttctgtattaatttctcagccttagagttcctggcacacactgttgtgtgtatggggtggggactcgggtaatgacaggctcagttccaattctctgctttgtggaagctcaagatttcattccttgcccctagttgacctttaaaacccaaatctctgcattatagcaacctaggacaaccaggtgtcaacataagaatgtgctgctctgctctattctcacttttttccttattttagtccctaaggagttcattgcctttcttcccagttcagctgtgcatttaaaaggatgttaaactccatgcagcaattccaggtgttttgcaaaaggaatgtttctcaggtccttttatagtaacctctctattttactagaaccaagagccctctctgcatactttttacctatttactttgaatagttttcatttttaatgcagccatcatcctaactcatgttatgctttacttcattcatttattaattaatcaattgtcaaaaattacttatatgaattgtataatcctctatgaaagattcaaaaatggcaagaaagagtgcctgtcctctacttgtttgagaatctacaattctgtgtattttatttaaaaatacatgactaaattatttttgttaggctctaaacatagctttgtcattctgacacactgatttatttctctggatgaaaccattctcaagtaatcatcttgtttttggataatgatcgttattgttctttgttttcttttgttgttgttgcctcctgttattccatgacaacattgtgtgtgctcatcatgttttagaaatgcaatggcttgttccacataaaggtttctccctgcctgggttttctttctttgtcttctctttaaatgttgctatccccagagtttcatccttggtctacccctctcctctctccatatgtatctttgggcattcttatttgctctcatgtttgaactataacatgcatgctgtattattttcctagggctgccgtaaccaagtaccacaaaatgtgtggcttagaaacaacagaaattcatcgtctcatagttctggaggatcaaagtctgaaatcaaggtatcagcaaggccttgctccatccgagactgtggataaaatctgtccttggctcttctagcttctggtgctgtccagcaattgaatgttccattgcttgcagttgcatcagtccaacctctgcctgtcttcacatggagttctccctctgtgtttccatatcatcttccctctgtgtgtgtctatgtccaaatttctcctttgtgtaaggacaccagtcattttattaggctcaccctaatgacctcatcttaacttgattaaatctgcaaaacctctatttccacataaggtcacattctaaggaactgggggttaggacttcagcatatcttgtgagggaggcacaattttttaacctgtaacaggcagctgtttctgccagtctatatcttgagtccccagggcactctcacagatgccagacccaaatataaacagaagaactgcactttttatcccaggtactgtttaagcatgtcacacatattgctatatttaatccatatagcaccacatgaagtaggaattattatcatccatattttggtgatgaaaaacctgagaaacagcaagattaagtagcttcccagatcccacagttagtacatggcagagtttagaactcaagtgctgtgactcccgatcaaggactttccatcctgagctctaggcccaccacactgcctgacaggtgtcccagaagcatcttaaacacaggatgaaccaaactgaaatcacctattttaaacattttttttttgtatattcattaacacctacccagctgctcatgctaaatctaagctgtcttcaattccattcttctctttgactttcaagaaaaacagataacatcattagcactgtagaaatgtaaaaattagccctgggcaacacagtagattattttacaaaattccctctccacctcctttgtttacttaagtcttatttgaaaaggctgttgcagaatgtctacaacaatttaacaaacacattctctcatcccattcctgtgttctcccctgggtatttttgtcagcacagcttaggaagaagaacccagactgtggagtcagaaagaactgggttcgaatcctggctcttcaaatgattggctgtgacatatttggcaactctcttagcgttcctagttttagtttctttactgtcgagtgagaatgataatgagtacctacatcatagggtggtcgcatgatttaaatgagataatgccttttctacaaagtgcatgtccaagtgcctgacaacagtgcatatcaatagatagtagctgtcgttgctttttagaaaaatgacttgattttagcctcacatttaacccaatggtggtttcctcaaccgctattcagctgataactttaaaatacacataataaactttgatgttagcatttctattttagtgggttttgttatttagttgtttgagcatagcaggaatttaaacagaagattaaagaagcatgtcccatcatatcgacagagtggaagagatcctcgggtgtgttcagggacgtaacaaagaaagatgaagacacaagtcatttcaccagcaggttctgggcctgagaataggctctggtctcacccagttgtgcaagtgttcccgggaaagtcatttcacctctctcagtcttggttttctcatgtttaaaggaagactgaacttagaccaccaagaatcctgcaacccctgcgagtctgcgattcctgctagttagatctagattactgttaacttgataaatcacatttactctcctccacacagaatccaagtgctggctgtgttgtctggcgattgagaacacaaaagacatgatcatcacctcactaaacttacaatctaatagaacagacaggcttataaataactcacgctaagaggattggaaacataatatatcagccatcagggcttggtcggagggtatgttctattacttgttattcactggctttcaaagcccagtgggggaatgtcaatatttagggaggatcatgtggaaactatgcagtcctctaacactctgagaactcaagatcccttctttacatgaaatcagactgccaaagactcatgctgggtgtctgtcctctacctgtgctgagctattctctaatgtaactcagcgctcacagaagatgtcacaagaaataagctgttgaaatgcagtgctgcaactgtggcaggaagacggtcgatggtcaggtctatggccccagtggccccaaaagggatccttcttttaggattctacactatgataaacattgccttccctgtgaaacttcttttttgaaaggaaaaattatttccccaaataactcttttcattttggctgccaggaagctcaaagccatactagaaacttaagtacagcatcttgggcaagcttgtggtcaaaatggctgcattcttccctcacatgctcttggcttctcatttgtatttttaactgccttagcactgattcctaatttccatttgataagtcaattgggtataagcccatcagtagtttagttcacacggcacctcaaatcctttgcagaatatccacatttaagtaagtatatacatgcatttgagaatacaatatgaaacaaaataaagtatgataacaaaataattggtaagatgtcataagaggagtgattaatttgccagaggatcaagcatggctcccttgacagggcagattttgaagatgtctggaagaatgagcaagagcattccagagagggaaccgcagggacaaggacaccgggtggtgaaaatgcagcgcgtgagttggggatgtggcagaggaaaacggcagaggctgcaaagggctttcgaaatcacatcatcgtgggtataaatgaagctgttcttgattcgtcctgtcatagcaatctccattcctcacatgctctgaaatactggtctgagtcattcatttgagctctcaatcacaccttctcctgtctgtcaaaaactacttaccccacatgggtgggtcttagctacttctgacagccttcggtcatctcctcagtgattaagagtaatgggaactccatgaacactttctaacggaatagaaaggtcctagcacaggggtctgagtaagacacaagtcatgtagcttcagccacacatgtttggtgggcaagaaaaggtgattttaaatctcattagagcttttattcacggtgaatggaacacagtaagagtttaatgaatgaattaataatgaagaaagtgaagagatacagtgaagagaagaatgtggctactcttatctctgagattactgattattgcaagggtctatgctgaaagtgaattattttaaaaatagaagcagaggcatttgaaaaactcaacactttagcacctattttaaggaattaaaacagaaaaagaggccaggcccggtggctcacgcctgtaatcccagcactttgggtgaccgaggtgggtggatcatctgaggtcaggagtttgagaccagccttgccaacatggtgaaaccccgtctctactacaaatacaaaaattagctggctgtggtggcaggcgcctgagatcccagctactcaggaggctgaggcaggagaattgcttgaacccaggagacagaggttgcagtaagccgtgaccgcgccattgcactccagcctgggcaacagagcgaggctccatctcaaaataaataaataaataaaaaataataataaaaaaacagaaaaagagaaatctttcaaaatgctataagctgctaaagcgagaggtcctattgcattttggtcagcattttgcaacttttaagaagtgaatggagcctgtgccttcctctttgttagccacttggttagcacatctccatgttcacagccaacacctaaagagtaacagtaactactgcaatgagtgattcttcatttttttttggaatgttaatgtgatactgttaatcatttctatctttcctttttgtctacttgccttttctaaaagtgataaaccatatctttattaaaaataattcaagtctattaaagtaaaatttatatcttctatctagattagaacttttcaaccttattgtacatgaaaattacatacacaataagcatgttaataatgtaaaatttccaaccccacacccaggtttggaacatttggaagtgtgtgtgtgtgtgtgtgtgtgtgtgtgtgtctgggaaagggtctcactctggcttcctggtgggagtgaagtggtgcaatcatggttcactgcagcctcaaacttctgggctcaaagaatcctcccgcctcagtctcccaagtagctgggactacaggaaccaccactacacctggctaatgttaaaattttttgtagaaatggggtcccactatgttgtccaggctggtcttgaactccttggcctcccaaagtgctgggattacaggtgtaagccactgtgactggcaggaaatgtgtatttttaatcataaattttccaggtaatcttgatacaagtggttctgaccatactttgaaaaacactttctaggccaggcgtggtggttcatgcctgtaatcccagcactttgggaggccgaggtgggcggatcacctgaggtcaggagtttgagaccagcctggcaaacatggcgaaaccccatctctactaaaaatacaaaaattagcctggcgtggtggcgggcgcctgtaatcccagctactcaggaggctgaggcaggagaatcacttgaacctgggaggcagaggttgcagtgagctgagatcctgccattgcaattcagtctggggaacaagagcgagactttgtctcaaaaaaaaaaaaaaaaaaaaaaagaaagaaagaaaaagaaaaacactttctagtcaacctccaaattaagctcggccaaaaaagagccatgtaaccagcatgggggatgtcacacttgtcaggcccctcttattacaactggtttcactgaatgacacttgggtttacgacagtgtaagagactgccctgccctatgagagatcctcctagatttacagatactcgcaccaaatacatagataaaaaccagagatgggaattatggcctaaccagtaccctttgggaaggcacaatcaacagtcttgccagaacaacaggcacaaaccagggctgcccagaatgcctggtggcgctactggttgaatgctttgctcatgactccccttatcttccttaggacaaacagaggaacacatcttcctccagactcagaattaatagctggaccatcttttcacatttgctttctttttatcctgtaggcactgaattatccctttcatactgcctgatgatacctcgaagccaaataacacctaccttttgcaattctgcaatatttaaatgttgcaattaaaaatacacatacacacacacacacgtgcgtgtaaacctcactcctggttttactctctctgttcaatttttactttagtccattctccacattcctttatttttaaaaagtggattctaccgtgctctttcatatgtatctatgtgagctttcttaaatctgttctgaaataggaggcagtgtaaatatatcaagtgacagtctacatttatccttcagggacattttctagttgacactttcttatgggcttttttttgacactttttttatgggcttctttattaactcaagatcatgagtatcaaaaccagggttgagggaatcgcttctcaaaagtgggttccaggtaccagaacccaatctgaacacggacaaagccccccagctcctctgtggttttatctctcagtctccgtacagtacaaatttcctcatcagtgtttattagggccactgctatctctagtgtgtaaacatcggcatgtattgatgatggtacaaatgtttaggaataactgatggtttttttttttttcactcagctatccgtgtgatttgcattagtgccaagcaatgtctctaagtagtaaggtctatgtgaaccactcaggaccaggtctggagaattctttttgcacacatggggtactccgtgccccaaatctgccttagtgaggtgcctggataccatggggatggatacagcagctggtacagctgcctgaggtcctgcaacctcatggccacattggaaaattgtccagattgtgcaatgaagctgtgtgtgtgtgtgcgtgtgtgtgtgtgtgtgttcatctctgtgtgtgtatgagcacacatacatgaagcttgaccaataactgaaagactcacaacttgcaaaatcagccacaactagctctcttacaaacactattaactgaataactgcctacactggcgtgaagcaactgaaggagggaagagctgaagagaagagtactttgctccaaagaaaggaaacagccttcacatcaaagcttactataagccaatttgcagagctatccttgcatccatccagctaatatttgatgagcagctactatgtataaaaaatcctgggtgctctgacttcagttgattctctgttctcttccccacacaaatatctctcttattttctaaatactttccttagtgtagaaagactcaagtctggccctactgaaaaggatatttatgacatcaaagcatattgatggcctcatggaaatacagcctcaccagttagaagatggtaccaggcattacctcttacatctgtgattcaatgaggaaccaagcaaggaatcttcagtgcaggccccctcagatggattctctcatctttgagatctaaacactttgttttgtctcctttgaagaaattacattcttaaggaggagggcaaagggtgagatgggttagggggcttcctttgggtgtctacttcactttgttcatgcccagagagtgtctgggcaacacaccactgccctcctgcctctcctccaggcacatcctagccttcgagtttttcttatgtgccacacatctggagtgggcacctgggacatttgtgtttctatttttcccatccaacaggaacagccccctgttctgaggcacagcagcaagtgaggcagtctcaggcattcaggtgcattgtcaagatcaaaccaaatgcatggcctctgtacctgtcaactgcctttcagtaaatactaaggacggttttctccctttcgtaatctaccatcagtgtctcctgtaagtcttaaaaaatgctttgaaatcaggcacaaccccaaaggatggtccctttcacaccccactgcatcgaaccagctttacgtgtttgctgaaagtcacatggtgacagatctaagctgaaacctgggattcaaatccaggccagatgttttgcaaagtaccctgcactcctgaactcttctgtctagaaggtgacagaagcccactgggcatgatccaactcaggtaaagggaaagtcacaccatggagggaatctaacctgtttgccatcacacttcgcagatattaatttaggtgaccccaggagcaagggagaattgagtttgtgcagatttcacccatgcatgcccttggctactttgccaacaaggagtaacttgtacagtgcagctcagtggtgaggtgtccgttcatccattctccacctcccttaatattcactgagcacctcccacttaccaggcactgcaactggccctggagatagggcctttgtggggcttatgttccattcagggaagaggataataagaaaactttttatttttttatttttattattttgagacggagtcttgctcttgtcgcccaggctggagtgcaatggcacaattttggctcactgcaacctctgcctctctggttcaagcgattctcctgcctcagcctcccaaagtgctgggattacaggtgtgagccaccatggctggccagtaagaaaacttttacataaacatgcaatataatggcagaagggaatgaatgaaatcaagaaaaatcaggccaacaggagactggcagtcacaggtggagacgagagcaattccagacggaagtgctcaggactggcctccctgaggccatgacattggcacggatacttggtgaaggaaaatgatatggaactacctggaattaagggtttcaggctgagctgacgccaaattcaaatccctgaggcaggaccgcagggtgaccagatggctgaaacaagtaacaggagggaacccacagaaattgctgtaagcagctgagatttaatccaatgccaacaggcagagactaaaggagtaaggcagacctgcctgagtcctaacttggcctcttattagcctaatgcccttggaaaagttggtggacctctctgaacttcatcttcctcatcagggaaatcatgagaaagatgtccatttgcaaagattgcttgagatcacgtttctaaagcatttatccaaatgcctcctgtagggtaaaggttcactgactggtgactgttgctgttgttcttatatttctggctttaggtagcatgtatcctctgaggagctttaagtcattttttctattacctttagtttggctaaataaataagttcttgtcacgtctttcaagttcaagagctattcctttgggttggttttgaattatgtttgtggtaaagagttactctggttattagaatctgtattacaggccagtgatagctggaattttagatgcttaagggaacacgtaagacagccatataatatatggctcccacatgtttatttttccagataagagaattttaaaaacaaacaagtctatcatctatcataaatagtacctcatgaaggacaggatatttggaacaataatctccaagaagtggcaattcctccctagaaaggtcacctttcatagacatatacacacgtgtgcatatgtgtgtgcacacaagcaaggctgcatgtttgcctggacatcctctttctctctgtctctctccatacgtagtgtgtgtgtgtgtgtgtgtgtgtgtgtgtgtgtgtgtgtatttttctctatgtggcaaaataaagagctggggctacatactgctgtctcacatattttttaaatatttgtatttttaaatacaggtgtatttttcttgctttgctgtcgatccgtgaacatgtcctcatgcatagacctctgccagctcccatttacaagccctgctctggacaaaggagatgtgatcaatgccacaggtgggggagaagagctccctgaggctcagcctagccttggggaagttgcgatctgccgagggcagtgaagctgtgggcacctgacctgctggcacgataactctgcgctcgttcgtggtcatgtttgggggtggcatgtgcttctcctccatgtagctgccgtagttcatcccaacggtgtctgggctgcccaccatcttcccgcctttggccacactgcattcatcaggagagttcctggaggagaagaaatattcttccattataacagcaatcaaagagcatgtctccatcgacttctcacaatacacagagagaaccaaagaagggcaaggcggaagagactgggggagaaaggacaagtgtgaaaagccaaatacaggcggggtgccgtggctcatgcctgtagtcccaacactttgggatgccgaggtgggcggatcatgaggtcaagagatccagaccatcctggccaacatggtgaaaccccgtctctactaaaaatacaaaaattagctgggcatgcctgtagtcccagctactcaggaggctgaggcaggaaaattgcttgaatccgggaggtggaggttgcagtgagctgagatcatgccactgcactccagactggcgacagagtaagattccatctcaaaacaaaaaagaaaagaaaagaaaagaaatgccgaaaacaggccttgccttctgtcctcccgaaatgcatattttgaagccctaactcccaatgtgatgatattaggagagagagcctttgggaggtaatttcagtttgatgaggtcatgagggtagagtcccacgatgggattagtgcccttattagaaaagaaagagaccagagctcgagctctctctctctctctctctctctctctctctctctctgccatgtaagggcagagcaagaaggtggccaggccatctgcaacccaaggacagagacctcaccagagactggccctgctggtgtctgattttagacttccaacctccagaagtatgcaagctcgagtcccattgtttcagccagccagtctgtggggctctgtgaaggcagcctgcacaggctaggacagtgcccatactggctagatgcacagaacacgcacaagggaggcggaactaccacctggcttctgtttcttaagcagctcctcctgaaactgtcatgtcaaaactccatctgtgacaactgattggggacacttgcagggaacagtgaactgctctttgttctcgcggtgtgacagcaaacaggcagagtagacagatgctgtggggcggcaccagggacactcgctgctcagtgaggtttatcctggaacgacgttccttctcaaaacctcagaatgaaatcctcctgctcaatttcaaatccctgcagccaatctttacatatggagctttgaagactcacagtgttccaggcttaggtgtagacaggaagggcagggaagggtgaggactgacgctaggggaggcctcatggggagtggactccagcagtcctagaggacccttgggaaagggatagggaaggaactgtgtggatgcagagaggggtcagctactgactactgaccgtgggcaacaggtcacagggctgctgttagtaaggcagtcactgtcatttggataaagtcaaacctacctttctggaaaaagaaaaggaaaacattttaaacagtgagttgtgaaagctacaggacattggtgaaatcgcatctgatagggaaatgctaaaaagaaaatccagcttagggccaggagtggtggctcacacctgtaatcccagcattttgggaggccgaggtgggcagatcacctgaggtcaggagttcaagaccagcctgatcaacatggagaaacccagtctttactaaaaatacaaaattagctgggcaagtggtggtgcatgcctttaatctcagctactcgggaggctgaggcaggagaatcccttgaacctgggaggttgaggtcgtggtgagctgagatggcgccattgcactccagcctgggcaacatgagtgaaactccatcaaaaaaagaagaaaggaaagaaagaaagaaagagagagagaaagagagagaaagaaaagagagagaaaatccagcttaagcagaaaacagaaaatacatgtcagtgccttcttagatggttaacacgtagatggtaaacccagggtcactgtagctgagaagtattaatatttagggtctgttgtctaaggcggatttccagaaatgcctctcaggctctatccaatgcatacatttttttcatattccttggaatctgggaaccttcgctttctctagattttagatttctatcccagtgtttctggttgtgggatccacgccaatgaagcctcatttatctcctccacttcttgttagttggagttctgcagagaacttggacaatcaaaaaactatgggcttggcatggatgtgaacttcaagtctaaggaggtcaaaaccatctgaggcaggagcgcactttctgagtggggtgagatggagaaggtcattccacacctgaaagccatagctgggatgtggacaggaagggaaagtgtttgttcagcatgtgggaacttgaaaatataggtttgttctcagcatcacttacaaatgtgtctgaagcctatggagggatcttaggtgttggcagtgaagagggtacactgccatctgcggatggaggttacagtcagggtcacgcaggactcaggccctaacatgggcctggaatgcacagccctgcctgatggcatcctcacagctgtgctaacatgaaggaaattttaaaataataatggtctgagttcccatgaagtagatcctgaatatttccaccgctgcctacacatgcattatttcctcttgatgctatttttcctggcttcacacatttatctctaaaagacccatcctaatatgaaaacacagagtgtcttcacttagactgagtttcctattcctctggaaaattccatcagttgagtagagtgtatatgttttggtatatttgtctcaaggagagaagttaccagggaagagaagttagagggattaggttctttaggaaaaagactttgcccagatgatgtgagtaactcaagtaacaactataaaatctagacaacctttgttcagattcaatcattcactcatccatttagacagctgttatcaagtgccggccgtataccaggtcccatcaattctttcttctccaacaacgcagttaacaatttgaaaagtaaaagatcaaagagatgtataaaattatagaaacaggccaggtgtggtgactcacgcctgtaatcccagcactttgggaggccgagctgggcggatcacctgaggtcgggagtttgagaccagcctgaccaacatggaaaaaccctgtctctacttaaaaaaaaaaattagccgggcgtggtggtgcatgcccgtaatcccagctactcgggaggctgaggcaggagaatcgcttgaaccagggaggcggaggttgcggtgagccaagaccacgccattgcaccccagcctgggcaacaagagcaagactccatgtcaaaaaaaaaaagaattatagaaacaggggacattgaggattttgaacccttcagaccaacccctttttcattttcttttagttctttctagtttaattttcatatccgaggacaagaactctaggcatagatcacaagagtttctctgtgacattaaagtagatccttcaggctggttgcggcagctcatgcctgtaatctcagcactttgggaggctgaggcaggcagatcacttgaggctaagtgttcgagaccagcctggcctcccaagtagctggcattacaggcgcctgccaccacgcctggctgatttttgtatttttagtagagacggggtttcaccatgttggccaggctggtctcgaactcctgacctaaggtgatccttctgccttggcttcccaaggtgctgggattacaggcgtgagccacttcacccaggtttctcttgcaaattttaacagcaaaagagtagccttaacatgtttgggatctgttttgggagcttaatagttatcagtcttcaccacagcgaactgtgttgctggcattgtctccactttccagaggtgtgaactgagtactcaaaacacaaggggctggctccaggactcacagccaggaggaggtagaatgagacttcagtgcgggtggcccgaactctccatccctgcttcttaaccctgaacagaatgactccacaaagtaaaggcaagacaatgtcttttcaaaggtaactagatcttcatttcaggaaggcatcagggactccctgacccatacactactctggtttaaggtgtacactaaagcactcatcctgacatactctcctaccctgggactgttcattccctgaaaagcatgtgcatgacacaaacagggcacatatacaagatgcaaataagaaagaggagtgattcctggagaagaaaagaattttcagagatatctgctttacttaagaaaaggacgccaggcacagtggctcacgcatataatcccagcattttgggaggccaagataggtgaattgttttagctcaggagttcaagaccagcctggacaacatgaaaaatgtgtttacaaaaaatacaaaaattagtcgggcatggtgtgcacctgtagtcccagctactcaggaggctcaggtgggaggatcacctgagcctggggaggttgagactgcagtgagctgagatcatgctactgcactgcagcctggacaacagagcaaaaccgtgtctcaaaaaaaaaacaaaagagagaaaaaaagaaaaggaaattttatcacaattcagagaactgaaaagtgttcatttgaaagtctcactataaatacatttctagctctgtgcccaagaaaagatccacactgcacaaatgtgtgtcttgattactccactgcaaccccaccttcaccaggcattccgaggctcacacatcgccgggaaaaagttcccgcaaacagcttggtatgtcacctgcaccaagcgctgcccagcatagaggaccacgtgttctccattctcacatgataaggatttggacgttcaatgcattgttttattgtgcacatgacaaagagtatgctgtgcagggaatgaacagtcctgaagtaggacagtgtgtcaggatgagtgctgcaatgtacactttaaaccagagtagtgtatgggtcagggagtccctgatgccttcctgaaatgaagactagttaccttttaaacatacacatacttttaaacatacacatacttgcatatgtgtgttgcagcagttcctgagaatattctcaggctattcagcaggtgcctgtcaaacagataatcatttagtaaatattaaatgtatctgtctttttgtttggggtggaaatttctttattgcaaataagcgtggttcaagatattgctctcacagactcctttgaggacaaacaaaaatcattttgtctttttatttaatttaaatagttttgggggaacaggtggtgtctggttacacgaataagttctttagtggtgatttctgagattttgttgcacccatcacccaagcagtaaacactgtacccagtgtgcaatcttttctccctcacccactcccatgcttcccccagagtccccaaagtccactgtatcattcttatgcttttgtgtcctcatagcttagcttctagttataagtgagaacacacaatatttggttttccattcctgagttacttcggttagaataatggtctccaactccatccaagttgctgcaaatgccattttcttccttttcatgggtgcatagtattccatggtgtgtgtgtgtatatacacacacgcatatatacacatatacccacacatatacatatgtatatatgtacatatacacatatatgtatatctacatatgcacacatatacatatataatatgtacacatatacatatatatgtacacatatacacatgtacatacgcacatataaacatgtgtgtatacatgtatacacgtgtacacatgtacatatacacatatgtgtatatacatgtatgcacatgtacatatatacatatgtgtatatacatgtatgcacatgtacatatatacatatgtgtatatgtacatgtatacacatgtacatatatacatatgtgtatatgtacatgtatacacatgtacatatatacatatgtgtatatatacatgtatacacatgtacatatatacatatatgtgtatatatgtatatatgtgtgtatacatgtatatgtgtgtgcatatatgtctatatatatgtgtgtatatatatatacacacacacacacacaccacattttctttatccactcattggttgatgggcatttaggctggttccacatttttgcaattgcgaattgtgctgctataaacatgcatgcgcaagtgtctttttcatttcctctgggtagataaccagtggtgggattgctggatcaaatggtagttttacttctaattttccatactgttttccacagtggttgtactagttccatagtggttgtactagtttccatgctgttttccatagtggttgtactagtttacattcccattggcagtgtaaaagtgttcccttttcaccatatccatgccaacatctattttttttttatttttaatgatggccattcttgcaggagtaaaatggtatcaccctgtggtcttgatttgcatttccctgataacaagtgatgttgagtgttttttcatgtttgttggccatttgtatttcttcttttgagaattgtctattcatgtccttaacccattttttgatgaaattatttatttttttcttgctgatttgtttgagttgtcgattctggatattagtcctttgtcaaatgcatagtttgcaaatattttcttccactctgtgggttgtctgtttgctgattatttcttttgctgtgaagaaagtttttggtttaactaagtcccatctatttatctttgtttttgttgcatttgcttttggattcttggtcatgaactgttattctcaaatttacattttcagttccaggttctatttgtcacccacagacattagtcttgacagtcctatgcaatatgtggcatcaacaagagtaaacaggagctgggaagacagatacttccctctgctcacagcagcagaaattccacattagccagggggccccaagaggtggggggctggttcagaattctgagaaagaactgaacaatagcccaatggctgggatattaaaaagccagccataacacctcacaactccctagcaacacccttggggccacacagcctcaaactcctgagctcaagcaatcctccttggttcagcctccctatgaatagctgggactacaggccacactccttgaggagtgtaacctctgcagcaatctcacacttttccatggcatttggtcataactgtggtcactcacaggaacacagaaatagtgtaggaagacaaccaaacattcatgatggaaataaaaaaaaccagaatgctggtgtccttcttctagtaactggagacgtgcccaatgaaactggcttgttgagcttcaaacaataatctcccttaaacagcagttggagaattaagttctaatcatttaaaatcatgagcactgacttcttaaaacatactagtattctgaattaatgagaaaaggacacggcaaagaatatcaaatacattggaaattttgttaaatttgagttaaggagagaaggcagacacgttgctaagcccagttgggttctcatagggttactgaatcagagggctggaagaagccccattttcaagcccccagacatgactgtctggaaaccacttggatgaacaagagtttagcttcgttaacagttttttagggaggggcttcgtaattttcctctgcaactccagagttctatttataaatatgtatagtggttttaaatagccattattcccctacctgtgtgcaagctatgtgaagtttggggtggcttataaaaatacatataagacaaaatgataacataaataattaacagaataaaaatgaggaaacaagggccaaaaaggaattaagagatgaaagcagcccactgagtaagcttactatttatcctgctgaggtaggataccaattcaactctgagctttctactagccaaagcaaagacacaagtgcatctgatgacaaggtttgaggtattaataagctacatacaaaccagttattcagcagaaataaagctctccctgggttaagctttgagagtttttctcggggcttctcatgaagaaaactggattatgcagtaaacaatatcgttcccaacatctcataatacatctaagaccatcccgcaccgtgccaggcgtagctggtggcagagcaggacgctccctgcacacagtgctcacatgctgcagccacagaggatgagagacggcatgtccccagcctctcctccttactggctgccattggaaagatcagacctgtcagagaagtcaatgcaaaaacatgaaaaaaacgtgtaattaaaaaaggagaaaaccttgagagatgcagtgttatacatgcctctagtttcataactcccaaatttctagatttgatttgattttattgttttttaagagacagggtcttgctctgtcacccaggctggagtacagaggtatgattatagctcactgcagtctcaaactcctgggctcaagcgatcctcttgcctcagcctcccaagtagttgggactacaggcacgtgccaccacacccagctgttttttaattatttgtatagatggggtctcactatgttgcccaggctggcctctaactcctgtcctcaagcaatcctcccacctcagcctccccaagaactgggattgcaggcatgagctgctgcactgaaacccctaatttctagattttaaattcaaatttaccaacactaaatagggtcatgtttatgtctcccaagagcaccaaatgcactgtgggtaaacaactctttccaggcctcagttggttaatcttccaaccagtatttcactgttgactaatgatgagcatggctccagactctttccacgtgtttatgttataataaacatatggataaagcatttaacatggtgcctggcacatgaccacgccaggtgtcagctattgctgttagttcatttcatctgcacatctccatgacagaaatactcgaaagcaggagccttgttacagatgaagcacagagaggttggataacttgcccaagatcacacagccagtagtggaagaattgggatttgaacctagatagtcatggtctcgactccaagtacttcaccgccccactctatgcccttgcttggtaaatccgtgtgaggagtctttcatagacctaaagcaccattgaatggatcctcagaaaacttaatttcatcactattaagtattctaaaagaacatcttcagagtggccctgaagacagtcatggatgagggttacagacgtgagctgagcagggcagccacgaaggagcaaggcagggccccgtgggagacttggaaggtggcaatgtttatgtagagatataaataggttttgataagtttggtctaaaagaaatagtcatctcaatttgcagttaagcgttctatgcttctccccaaaacttcattgctgtgcccagcagggtgcatgttttacacagatgatgggcaaacattcttaagtgcaaaaggaaaccagacaaaaagtccccatgacgagacagccgagtgggagtgcatctgactctgactgcaggcccaaaaagatggaggtgaggaccaggacaggagctggaccactggggaagcagtcaatctaattttttaagattaaataaaataagtccaagatgaaagcctccttgagctgtcgtccatacataataccccttaaacaaaaaaaaagcggggttggtggtggggactaatattactgaaaaaacatactgagaaatgtaaaatttggtctttagtctttgaaaaacaaaataaacttggcatctgactttggttttctcacatcagagtctacttacagcgaggcaatttccgtcatggaaagaacccgcaatgaaatggcacagccgtggccattagcttgacaagcatggagcctcagcccttgtgagtgtgaatgggcctcatttatccaagaacggcactgaatacatcccagaggggcagccccaagctcgctggccacattaaatctgattcaccctcacttcagaacacttagcaggggcccactccttggagaaagtccaaggcaagtcagaatgtaattgcggaaatcaatatgtcttcttctttgagtcagtggaggcaaacccgctaatcctgtcgaaaatctacctattcttctagagccatcctccttcctaatcctctgaattcctcttgcacctggacacgactttccaaccccttgttctccatcacatgctggtgaaatgtccccgaactcttccaaagctttctccctcctgctaccagagtgctctcccccaaacagaaatgcaagctgcccatgtccaacctaacccccatcatggcccagagcccctccctagattctcctcagtgatctggctctggagcccctcaattcactcatttgtttagcaaatatctgtggagcatctttctaggccaagcactgccccaggtactggagttatatcagtgtctctattaacatggggctggcatttgagtagccaaagcccctctccccaactccatgtgctctgtgctcaaagaccacattccacatcaccccctagtctcttcccttcaggccttcacttttgctactccctctgccttcaaggcctatgaccacctgatacctgccctattcacctgttcaccacctggtacctgctctattcacctgtccatgctcacctctaggttctctacaagcctttcctgggccgccagagaggaatgtctcccttccaattgcaccattctctgtattttctcagtaagtgtctgcaggatgagtgagtacatttatgaatgaatcttccatttaaatattgagttccttatctcatacctgcagtgcaagagaaagcccctcgtgttgcagtcagaaaaccattgctgaccttggttgaccttagatgggtcacctaacctttcgaggctcaactccttcattcataaaaatgaatggatgctttcttgaggttgctgtgaggacatccctgagatgatgcctgtgaagaaagtctgcaaactgtgaagcactatacagattaacacagcaacatactgcatgtgcatggctgtgcatgcgtgtatgtgggtgtaaatgtgaggctttttgttcttggcaactgttcataactgtacctcggtgaactcttaggtaggtcaggaagctaaggtttactattgtgcagtgttcagcatgcaactgctttttggaatgtcactgtctttctgaatgttccttttggtttattaggttagttcacattaagaagaacttggtgaggaagccacatggaagaaatggaaaggctttctttggcagctctaccctaagagggcaaaggggtcagttctgcgagagaacccccacaaggaggctggcccgggacaagcattccaggcctgtctcaagtctgaatacaaataaatcccttctcaggtggttttcttcataaggatcctaaaagcatatacttagtcctaatcgactgagcaagctcctaatcaagtttcatagtgtgaatcggaggtcagtcaccacaaaaggtatttttaggaccccagacaaggaggggattgtctggagcgctgcagggtaatttgtgggtctgttttatttctgaatcagaggcagtggaaaagctgtttcagaccccatggctggagcagcgggtggagctcagcagtgattcatgtagaactccgggctcaaactgaaaccgtagatgtttgtcttcacagctgtgtgttatttttacccttactaaatattctctcttacacctggaatttcagcctcttcccaacagtcctgttccctcccccttccctgaagcagttgaagacaaaattaattaaaaagtcaccaccagctcaccaacagttagttctttgtccccttaaaggggctcgatgtttccctgagaaagtttcattatttaagtttatatttctctttacagccaaaaacgaatgccagcaagaccgtgttgcttttagatcttgaaaactggagggaaatgcaccattttgggattcatcatttgaaaacaaaatgttctgtagcataagatctctacaagcagttacatgacaaagatcagatgtgacatcttttctatcttgtgcacgtcttttaatttgtctgaaagactcctttttcagagaagaaaggattgagcccaatagccagtatggtgcttcatgtttttataacaggccaggtgaatcctggtaaccaaaacaattttactttctttttttcttttttttttttttttgagacggagttttgctcttgttgcctaggctggagtgcaatggcgcgatctcagctcactgcaacctccgcccccactgggttcaagcgattctcccgcctcagcctccgggattataggcacctggctaattttttttttaatatatatttttagtagagatggggtttcaccatgttggccaggctggtctcgaactcctgacccacctattatttttaaaatgtgattgttttggaaacacctggtgaggttaatgtaaaggtgagtgcaggtgaactgacctgatgtgataaagtaagatagtaataaatgtttctaaaatgtgtaacatatacaaaaaatcaaaatgcagttggcacttggatttggtgcatcttgtcactgcttgtctgacacgtggagagaaccttgctatccctctcaatgcaggaaagacgttcagcttcttctaagaagccctgagggagtgaagaagagtccaggcctgtggtcaaatggccaactttcactttcactaactttcacttgagcaagtgacgaaaacttttggaaactcagtggtcatccgtaaatgtgaataatcataataatgtcatctcatagatgtttgagaaaactggacaatatgttgtataccaaaatctattaataaatcatgtgggttttagaaatatgggttaatattatccctttcagggtctttttctcctgcccaggtagagttgatggtaccctcatatctgttattgctgggccctgaacatcgctctgtactgaatgtgtcttatgatctcacagaatctttttcacctttggtagaccatgagctcctcttagttccttttttttttctttctctcttttttttttttgagacagagtcttgctctgtcactggagtgcagtgccgtgatctcagctcattgcaacctctgcctcccaggttcaagtgattctcctgtctcagcctcctgagtagctgggactacaggcacctgccaccatgcccagctaacttctgtattttttgtagagatgggggtttcaccatgttggccaggctggtcttgaactcctgacctcaagtgatctgcccacctcagcctcccaaagtgctgggattacaagtgtgagccacctgcacccggccagcttcacttaattcttaatccatctccatcgaagctaacacagtccatgatgcagattaaacactaaatacacgttggtttcctgcagcatttgtcaacttcgacactagtgccactcggagccaggtcactctttggacaggtgggggtgggggctgcaggggcgctgccctgtgtactgcaggatgtccccggcctctacccaccagacaccagtaacacctcccagctgtgaccagcagaaacacgagcattggcaaatgcctctgggggccacatcacgatggttgagaaccactgggctaatgaattaagatccactgagctcaggcaaggaggcaagagcctcttgttttacctggtgtttattagagagaagttcctgtccccagtgtctggggtgatgcttaaaaggggcccttaaaggggcctctatgctcatgaggattcctagttatggtttgtccgtaccttgtttggggtacattccccaagccttggcccatcctcgcttcctcttttcctcatgccatatgtccaacccatcagcaaagcacgttaattccaccttccaactatacccaggatgcgactgcctctcccaccctcccttgctaccactctcacccactctcacgcagatgtctcccatcctacacccacattttctcaggaagacttcaacacaggagccagagaggccctgcaaaatctaagtaacactatatccctcctttgcctcaagtcccctaatgatttctgaactcaccagaaagtgaaagtcaaagtccggcaatggccccacgggctctccaaactcatcatctattactcttcttcttggacactaaacagcagccacgatggcctgcttgttgtcctcgaacacctcaagctgacctcagggcctttgcatttagcattccctcctcttggaatattttctgctgtttaatcacgggcattctccctcaactgcctttgcagctttactcaaacatcacttttttgtgatcttctccagccaccttctttagagctgccatccgcttcacgtctttatttttctccttagcatttaccatgatctaacctgctgtgttttcataagtggtctgatgtcatgaccatcttcactgctagaaagtgaacttagtgaggcaaaacttttttgtatattttatcactctatcccaagagactaggaaagtaggtgctcaataaatattcattgaatgaatgaatgactccacgcataaacagtatgtctaaggccctgatggacccagcagatactccctactttttctcatctccatcacatgacaaatggcatgttttttaaataacatctataaaacatcctgctatctgacccgaggctggagttattcatggcatgcaatgaatctatcccagagagaggcaaggcccagatagcattgtctctcgctgcacaggcccagctgggcaaagcgccaatgtggcgggagggaaggaggtatttctcaactcaggcaaggacttctggggaacaaccccacctccgcgtagatcctcccagatcattcgctgggtgggtcacctttacccagctgctgggctttctcatttttcatctccttggatcgtgcaacagagcagtggttctcagactaccaggcatcggaatcccgcagagggctccttcaaacacagcgtgctgggctgccacccaggtctcttccgattctagggcagggcctaagaagccgcatctcaaacaagctcccaggtggaggtgatgctgctggtcccggagcccacgctgagaatcaccacaccgggggaaccctcactcaacagaatcaaacatggcaatggctccaggtggcctgcagactgggctgaggggggactcacagcatggcacataaattgactgagttccacctgcagtgagcctccaggtgggcttcacgaaatcgccatcgcctgtggaaaggggaaggtgccacttagtgtaagctgcctgtgatctggctggcctgagctggggatgctcagatggaggaaaagcagcctgctctgcacagacctgccagcctgctcacgagaagacagtttgcttgtggaccatgagtgagcaggtgttacctcttggcttatcctgctagtctatcatgacttgagctttggggacctcacagcaaattcagggcattggtagggagctcacgagaggctgagcaggcgctgaaactcccagccaggcccttggtgtggatggcacaggaaaacagctggttttagtttggccacacactgacagttctccattgtgtgaacacttggggctttctggtgcgtgaggctagagtgaagaaagggagagggtggctgtggaccaccgaagctgaaaaatgatgtcctgtgtctacacaacgtgcaattagattactgtctgcaagaatgctgctgtttgatctggcagtggccaagccaaacccacaaggacatcccagttggctcgcaaagcagtggttcctttctctcctgtttttcttttattatgctttacagaaactctattataatggcaacagatctcgtttcaccacttgtatttcatttcaggagcttgtaagcacgttaggactgaggttttgtagaattccactattcggttgggaactaagtccttcctttctctcaaagcacatggcctttttctccgtgggtactggatggatagggatggacagagggcactattcccaagctgggtattctaggcagaaggaggtgggccatgttctggaaagacctaagctgcagagagtgcacttctcccgtggaggtgtctgcaagatagtcaggggccacaaaggtaacagcccacaagttctagccaaagagtaatatttgacttacgtaacttccccttggacttgacttcaagtggcatgtgcactacaggaaagcccattatgcataagctaagaggagggacaattagaagaagctattgggccaggggccaggagatgggctaactccctggcacagctggcctggggcttccgagtctggaaggatgcaggtgcaggtagtggagcgttgaggagctgcactcctggcggggctcctccagaggcaggcagccacacactgctctgcagcatctcatctgtgagcccctccgtggcagaatctgcgtctccgtgaaccctgcctctgccctggcccctcgagctgggctgacacagcccggtgctggttcacggtgtccaaaataaagcagagtgaatcacgcccatgttcccttttatggagctgcacctgacattcgtaaagagcccatagtgaggccgggcatggtggctcacgcttgtaatcccagcactttgggaggctgaggcgggtggatcacctgaggtaaggagttcgagaccagcctggacaacatggtgaagccccatctccgctaaaaatatgaaaactagccactcgggaggctgaggcaggagaatcgcttgaactcgggaggcagaggttgcagtgagccgagattgtgccattgcattccagcctgggtgacaagagcaaaactgtctcaaaaaaaaaaaaaaaaaaaaaaaaaagcccacagtgagtcagcaaagcctgcggatgggatcccaggcagtcctttgtctgccccaaggctgcctccaacctctggctgagatgagtcttagctccactgataactgttcagctttcttttcccccattccccttcaggaagcccgttggattgttaatagcagaacactgactcaccacttatgtttcaattctttcagatcactgagcttgagcagccccctagtgaacctctgacctgacacgccaccccctttaccacccgctgtccagtcaggctgagctccagcagcagcggtgaactggccccccagagcacactggtttggagatctaaaaagtacaatgggtcaccagtcactgatgagtgcagcatccctggaagtcaggtgtgggggtcagtttcctgtgtcaacttggccaggccgtagcacccagtgacttaatcaaatgctaactgaggttgtactgggaaggcatttgcacaggtagctagtcagttgaacttgactaaaggagatgatgtcagataatgtgagtgggccttgtctaatcagttgaaggccttaagaacaaagcctgcggtttccagagcagaagaaattctgcctactttccagcctgccagcctcccctgcagatctcagacctgcccactcccacaactgcattagccaattccttcaaataaatatcttaaaatgtaaaaatatcctataagttctatttctctagagaatcccaactgatacaccaggccagcacccagacacaatgccaggagacacactgagctctgggggagacgggcatgagctctgtatctttctcttctacaaaggggattagtgtcagccactcctctccctccccctggaacatccttgtgggtaggggacgatgacacttggtgactggttgacatctgtacattgctagatgcctcaaagcggaggcagcctctgcagccagtgttcctcccctgcctattacaacccagctgcccttttcctcaaaggaggcacgtaggcctggattgaaggcagatgaggtccaccttgttcccttcatgaacagcacctgccaaaccgacatcaccgaacccaccggaggacccggaggatgaagaggatgacatgatggtcttcactcggtatccacccaccaaaacacatcaccgatgctttaggagctggaacagcattgaaagtttatgacggcagcaatctgggcaatgttagaattctatgagccctgagagaggaactcttaaagttcccattgtttccttgaaagaaaatgtcaaggccgggcgcggtggctaacacctgtaatcccagcaatctgagaggccaagatgggtggattgagttcgagaccagcctggccaacatggtgaaaccccatctctactaaaaatacaaaatttagccaggcatggtggcggatgcctgtaatcccagctactcaggaggctgaggcaggggagtcgcttgaaccccggggggtggaggttgcagtaagctgagatcgtgccacttccctgcagcctgggtaaaaaagagcaaaactccatctaaaagaaaaataaaaaagaaagaaaatgtccagttcccctgaaaaagatgtttcccggaaagagaccctcagcgcagcaccagcctttcacttgcctgacagaaaaaccacccaagagctttccccagtctgctgcgctgagggccctggggcggaactgccctggtgtctttcttatggactgaagctcctggtgtctttctttcttatagactgtagccccttgcctggggctcagggttaccccaaactcccaacctgtacccctggggtcacaacacaggctggaaaagcttccccatgcctggccaggagggagaggagacatcagctaccaaggggcatcacaggctcacactaaggaaaacagtgtttgcacttctcccacaaacagaatgcttatttttttattttttatttttatttttttgagatggagtttctctctgtcgcccaggctggagtgcagtggcgcgatctcggctcactgcaagctccgcctcccgggttcatgccattctcctgcctcagcctcccgagtagctgggactacaggtgcccaccaccacgcccggctaattttttgtatttttagtagagacagggtttcaccatgttagccaggatggtctcgatctcttgacctcgtgatccacccgccttggcctcccagagtgctgggattacaggcgtgagccactgcgcccggccagaatgcttattttattttaaattcgggagtaacacagtgagaacaatagaaactttcatttctggagcactgttctcgcctcctcactcagtctcccttcggaggcttgctgaatccagactggccccaggccagactctcaaacaagggccaggacatggctcactctgcctgttgtccatcggaaatcatctcagtgcccttttgtctgagatgtttccttcctctctccccaccttccaacatccccctcctccctgcaggtgaattgctcataggtagaaattagcctctgcagaagaaaagctttagaaatgtgtcccggtcttagtgtctccgccgtgatcacgctggcatatatgggatcatatgaccccacccaaaacagaattcattcagtgtttccaggctgtgttccaccaactgatctactgcataaacactgctgcattctttagaacatgattaccctgcattcttctgtgtttcagaaatatatatagttaatgatcaacagaaacattgtatcaaatgcataggatttatgggtaaaaaatatttacatgtaatcattaatttcccacaactttggtgtcctggacccatcattgcattttctatccaggtccttctgtaactccaggaatgaatctcttgatgagattcaaaaatatttacatgtaatcattaatttcccacaactttggtgtcctggacccatcattgcattttctacccaggtccttctgtaactccaggaatgaatctcctgatgagattcaagatgggcctgcctcgagttccacttaaaggaccagtgcggtggcaatatgtagcatcagagccagtgcactttcaagaagcagatgcacagacgcaaactgacttctcagagtggaggagtgttctggcatctcccatctccccatctggcacgtccagccttgccgttgacattccctctaggacactgtgacttggcaccttcattaacaccacactaggaattgacgcaaccgtttccagacttataaactatgacacttataataaacctttttagcgttaaaacatatatgtaacaaaaaggccccattacagcttcaacagagtggaaaatgctcagggtgtggagtcaaacactcctggtttaaatccaaactctgattccatttaagtggtgatttggggtcagactggaaatgcctgatcacaggtttcttcatccatcaaatggggtcaagtatacttcatgaggggctgctcggaggactgaggggctactggatataaaagggctttgtacacagtaaagtttccgaaaatgtgagctgttcttatgacctgatggtagattatgcaacatttcgaagaaataatctgttctttatcctaagatttgatattctttttcctgaatatatatggggtattagatcataattgaaattaattttacttttcaaaactacacagaattcaacactttttgagggccagggacagttctgcatttggtaatacattttacgtgacagttgtatgttcatgacaaactcagggaagctaataattatgggagacactggagagggctttatgtgtaagctaagaggaggaaaaaaaaaaaaaacaaacagcaggcattaagagaagaggaccgcagagatcagagggtggggtgagggtggagggcagacaatggagatccactagcaaattcaagtggcttggacatacgccgcactgcctggccactagctgacactctccctttgtgaaaacataagacggcattattttccaggcaatcaaacctcagatgaattctgccatatgtgggcaaggctcccctcccacagagccctcgtgcctgggaaatagaattgaacacatcttcaaagagagttcttggtaaatatactactaattttacaaactccatcctctacacaaaccactggagaacacattttcccagcgctgtccaacgtcaccgttcaatggcctttctttctttctttcttcttctttttttttttttttttttgttagccagagtcttgctctgtcgcccaggctggagtgcagtggcatgatcccggctcactgcaacctctgcctcctggattcaagtgattctcctgcctcaggctcccgagtagctgggattacaggcacagtggccttgctttctaagtcaatctttagagaagcatgactgacttccactttgcctttgcaaaggataggaaaatgggaggtcagggagagaaaggggcggaagtctccttaccttgagccattcacctggctagggttacattccattttgatggtgaccctggctgggggttgagacagccaatcctgctgagggacgcgtgggctcatcttggaagtctgtccatagtcgctggaggaggacgcggtcatctctgtcttagccaggtgtggcgttccgtaggcacactcaaacaacgactggtcctcactcacaactgataaggcttcctgaatgcccaaagaaacacataattcaagacactccaacagacagtcatgtttcaaaaagttgttgatttcagagtcctttctaactgggaccacattttagatcgtttttatggtctccatttctacctttcagaagaaaaaagtagcttgtttttctttcctcgggacagtaagagttagaaatgccagcctagaaaaacttttatgcaggtctcgaagcatcccaggcttgactgtggcagggcagcagaatatccactttaatctcaacttaaggaagttgaatttcaaaggtcttagaagacatccaattgcatgtgtcactatttgacaaatgcaatctataattcaagcagacagggtacagagcggtcatgaggattaaaaaaaagaaatctgaaggccaacacctaagcatctggcaaaattgccacattcctggggattttgcggaagagggacttagaggaagacagagggatcaatggagcaccaaagggcaaccaaccaaagatacaaacgtttccactctaagttattagccgaagtacagtttcaagtggtgcttccatgatggtgagcatctggatgataaatgaaccaaaaaaaaaaaaaaaaaaaaaaaaaaagctgtgaagtatccagatgcttccaaacagcaggatgtttaaaatatctggatcactgacaagctcttttttccccttactttcaattaatatcttcgctcttttgcatgatttggtgagaagaaatagcaatttgtcattgttggatcaatcatttttcgtggttttaagtcaaacaagtggttagccaatggctatgtttatattctacagccaatgagcaacggcaagtttgggaaatttcaacgacttaaatgatggcttgtgctgcaatgacacagagctgttgtgatacaatccaattttggttcttataacagacaaaaagaattccacatgaatgctcatttttatattagtcctttggcatcctcagtattgacatcaactagtgagaagcaaaggctagttgggccacacatttttatttaaaaaaaaagaaaaagaaaagaactttggaggcagagcaggggaggcaggggagtgtgggctgcgcagacccttccagtccaaacttgtcatctccaaatgagaaatctgagacccagaaaggtctagagctaatcttgaatgagctggccatgatcaaccaggggattagtgatgggaatgacttgtgtattaccatctgccttctccttgcccccacagccctatgatgccctttgtgacatttttttcctttgggacatgtgtttaaattagcaccctcttccccttctctgagatgacctttacataaataagggtgcttcccatcagtaatcacaccctagaagcagcccttctgagatggagagcttcctctccacccagaaggatcagaatttttaggaaacaatcacccccaactccacatctactctgtcgctcgatcctccacctgtcccaggaccaagttttttccttagcttcccaagtgcacaaacttctttgccagacacacggcactgagaatcagcaaggaggaagaatcaaaacaaactcaaacctctgtctctcaaagtggtggtcaggtgtctgtgctaaagcaaaagcccccatcctggactccataagtatctgtagaattacagccctgtgacaccctgggaaagactaagcctgctgtccaaacagtaatgcaaaatgtaccaaagagtcaggtaggccagacagagaaccagaatcaggcacaagggaaaaaagtcatcttgaatagacagcaaaatcaaactcatcaacaaccaaaaatgatacgaggcagtgacacagaagttgacagtacagaaacggcatcctagatgttagggaacctgaaattcatggctttctcttccagtcacaattgagtggccaaaacaaggaatctaaacacatagatgtgggtttcaaagtaaaatcagcaccatagacttagtcatgctaattaagacaaaaattagaccttattaaaaaatttttgcaaaacagatactcccttcccatggtggcactggctagtgtgttttacaggctcagaacaggaaacagagctgatggctgctgcctctctccttcctgggcctgagactcgaccaaggctcgcaggggaataacacactatgtaatgttagctttggctcacccatgatgagaaacatgaacaaatgtgtgatttatatcagaaattggcgaaaacaggttatatatataagaaacaggctaaatttaaaattacaaactaaaaaggaaatggctgcaacaataacaaacaagcaataactttaaagtattagtatttctccaagataaagtaagcttacttctgcaaacaaagccaatagccacaaaaatgtagtgtaagtttgaataataaaaaaaagaccaaaatattagaactaaaatgaagcttaagtgtgtgtttgtaggggaaggaatccattctcacatctggcaaagcattatttcagcacatggttttctaaagaaagaaatcaaagttaattgagatcgatttaggaaggaaaaaaccctcagaaatgctagagatgggggaggcatgcctcctttttttgcatcttaaaattcttctcacagctaatattgcacaaaaatgaggaagggaatataattcagaatattgaaagcaacccctcagttgcttttgttcattagaagggaaaaattctgaaaataaggaagcttcaggataaacacttcaaaagaggtgaaatacagtccacattttgaaaagacagagcaacccaaactatgccccaaagactttgttgattgtcactcaacaaaggctgctgaacacctaggatgaagtacagctcaggaaaaggaaacaaatgaataaagaaaatctctctcacatacacattttgggagtaagaagaagctgaggggttttcacagacccattcccacaacagcggtcactaaagttaagtgctgctcttcagaagcaaaccaaggcacagccctgccacatctttgtcctcccacttgacttggctgttggcaggtttcatcatcccttcggttaaagcttgaatggacacacgctgctgcatagggccctccctgcctggcagccctgtgacttcaaaggggagagaggatctagcccagtaggattaaaaccagaaaaagagtgctgaacacaggctgctaatcaggaccacatgagttctttaactccagctctgggagagacttcctggccttgactgacatgtctctccttccctgcagcctggctcctcctctttataactagcagatctcacctacctacttacctgcctgcctacctgccggccaaggtaggcagctgccttagttagcatgtatagattgttattgcagaaactctggccagccacaaggcttgggatctgcttcagtggctttataacagagaatattttaaacgtcaaaatctggcagatatgtggcataatcatttcatatgcctgcttctatgttactataaaaagacctgaactttagattggtgtttgccaatgtgtggggtgtttttttctgtagctccaggaaagttgggatattcccatcaggcaaatggcaggctaccaagctcatttttaaataacttacgagaaacacataattctaagcaaattacccccaaacaaaaggtactactgtgttagtactgtagtattgattatttcatttcaatacggaatataccaataacacatgaggaccattcctttggattttggtcatgggataacagttccagaaatgaagggaggtcccaccaggttatatttcatattataactctaaaatatgcatctattttcaagtaactagagtacaaaaaaggatccaaaatacattagaacactgaaaaagaaaactaacaaagttgaatgcatactgacattttcagcaaagtatttcaggaatcctgatgcctttctataacagatgaatactttgcaagatgcctatttctcaaccaaagtattagaaaataaaggcccaaaattgattctaatttgtgatccttatagctcataaaaatattacattgttaatacagagaatccatcatacttaacctcttttgaaaatttgggagtggtaaagtgttgaaactgagaaaatctttaagaatggtcaggtgaatttcacatctggagtaagcaaaggcatccatggtcctttcgtggttttcaaaaattaggaagatggccagaactaggcctctcgagaattggattatcaaacccaccttcaatgttttcaagtcttatatgctataattatttgataattatgaaaaacaaatggaacaactaagtggaacaagaattgtatgatcatgatcatgcttaaaaaaaaaaaaatcttggttcgggcatggtggctcacccctgtaatccaagcactttgagaggccaaggtgggtgggtcatgagttcaggagatcgagaccatacaaaaatccaaaaaaaaaacaaagaaaaaaaaatagccaggcgtgatggtgggcgcctgtagtcccagctactcaagagggtgaggcaggagaattgcttgaacccgggaagcggaggttgcagtgagccgggatcacgcgactgcactccagccgaggtgacagagtgagactccatctcaaaaaaataaaataaaataagaaataaaaaataaaaaaatcttaaagaagtccttgctgctatcacaacacagtgtggagatcattcacttaggaagccagcatcatcttcaatcaatagcctactttttctgtcagttttaatcccattacaatccaatacaaaacccttccttaaatttccctcacatataaccacgcagaatttggtacatcacttaactccctatattgccatcttttaaccactttcataaatagcttatccaccaaataaaccaggttaccttaagcactttcatgcaatatcctcttaaattctattttgttgattacaagatacaccacttgtcacattttatcagctctgaaatatgaaaatgaaaggcttatcctaggtatcaggcagcatttcttcttctctgatggcagataaaataatgggacattttatatccaatgacatcttacattttatgaaaaatgatcatttaatccttacaattgtcctataaggtcagctgtgattcttgcccacccatcagaaagtgcgattagagaagtaacatcaacagtgaggatgaggcagaaacagggtttgtgtctgtgaatggaatcattccccaaggctgtagactggccactacctggctgttactggaaggaagaagttggattaagaaaagtcacacggtggagtgttttggtgcctgctcttgccatgagagatggaatcacctagagagagacagagagagagaggctggtagagggaagagacagaagaaagatgaagggataagtgtccagaatccctggatctgggatggaataaaggatctggatggtaaacggagagtgctgggaaccagtaaggacttctctaggtataccatgctcttctatgagcctaggggatgtgtagcaatgggccctgcatacagttaatcatttcttttgcaatggcttaaatcaacaaccttgttcttttctttgattaatcagattattcagacacaaagacatggccaggtgttgggatgtgttcattgcaggtggatgcctgccttctcttaatgagtactatgcaggaaaactaggacaggtaggagtaccatttataaatatgctggagcctatgccactttgggcggcctttagtggatgtctgcagacctaaggatattggaaatctatctattaggctgtcgcaggctctattgtttatagtttctcttcaaggcagcacatatgcagtagatgcttctaaaaggtctagtatctaattgtatttggaggaggaaaaaacaacacaaacaaaatagacaatgcacttagagaaagctctgctctcccaccataagcctgacaaagatactccagtccttcaggagtttttattctaaatgtgtgcacttttgcaattctgatgccaccagtatctcattaaacaagaatcttcatctgaccagtgtgtcttttatttacaacacacaaaaaagcgaaacgtggtaagtgaaagaagcttcacaaagctgggtatgatcatttttgccccttcttgatatgattttcttttcttcttaattcttcagagaaggaagtattaacatcgtatattaaatgcagcatctagctttgtgttcacgtttttctaatttaacacattgcaattttagtccttcaaaactataaaaaaaatcttggattaacctcaaaggaaaaatgtatgtaggcaaatgaagtccatctaaagagagtatttctccaatatggtatcacttcagtgtcaaataatttcaccactcacaacactagtccagtgctaagaaatgagacccagaactagtgtccagatacatttgcacatacagatatacaaacacatacacatgcttacatatgtacacatatacatgtgtgcatgcatgcaaatacatacatgcgcaaatacatatatacatacacacacatatatacagatacgcacatgcatatacacaaatacatatataagtgtatgcatatatgcaaatagatacctacagaaatacatgcagatatacaatacataatgtatatacaaaaatatcatacatatgtatacatattactaaatacatactaagataataaggagagatgaaaatctttatccttattatctttattaatagaacgctttagaggactttcagatattctttatctttaatcatatccactagggcaaatgttgcctaaaagatacagagaacctggcttcttcccatttcacctctgctccttcctctctcatcctagaaggtgcttttccctatgctcagcacatcccttcagaacagacttagctggggatccatcccctccatgtccttcagccaattttcccggctctggactcacagactttctcagggctctgagaaggcctggctggtgccagcaattctctttgcccacatacttctcccctggccttgcctttattcaaatataagcattttcagggctggctcctctgtatgtctgcctctagaaataagataatttcttaacctcaaatgcttgttggtgttcatattagccctaggactaagacatcaggtgatattacagccccatcataatgctataaatgggatccacaaacttctattacatccaaatgaagagacgtgtttttgtgagatgaatggattgtgtagccaacgcccaggagttccagggagtttggaaaataattgccattggcaatatgtctgcagtcatactaccaaagagcgtattattgcagagtttcaccttcaatccacataggcttaaatagggacttcctatagctaagcaacctatgaacaaaataagacttactggaaaatgaacgtttgcaaaagaaggagggagcattcaatctggaaagcagaaactctagaaatattgtgaaagattggagcatggtagaaaaatgttaaagaaagaatagttatgtccacataatgaaaattagatttaaatgagccttgggagatcaagaatgtcaaccaacatcattttaaaacaactctgttttctcagtgccatgcagaataaacctcgaatgcatttgaaaggacaatgaactgggactctttgccctggcaaatgccatttaactgtttaagaaacaacatgcctgtgatgtgaatagcttcttattttcttctttaaagaatcgcttttttggctgggtgcagtggctcactccagtaatcccagcattttggcaggccgaggcaggtggatcacctgaggtcaggagttggagagcaggctggccaacatgatgaaaccctgtctctactaaaaatacaaaaagttagctgggtgtggtggtgtgcacctgcaatctcagctactcaggaggctgagacaagagaatcgcttgaacccgggagggggaggctgcagtgagctgagatcgcgccacggcactctagcctgggcaacaagagaaaaactccatcaaaaaaaaaaaaaaaagaagaagaagaatcactttttcttcccagtaggcttctttccttctttggagatgagcaaaaagtataaaaacatctgtggaaacctcctgtttgtatgttttacattggaatgggtgcaaaaaatacactcactattcctttacatccttctaagagggctgtttctactcttgacactcaatacttgtttttgtttctctaatcactgttatacgttactcacgaatattcatcaaaacccttttccttattttttatctagttttaaataattcatttgagataaaaagaagtttttctttgctttttttaatcactcagtggaggatgaacatgaagctgtaccaatggataggagaccgtctggtagagcacgggagccagggatagggatctgaagatggaagatgtgagtttcaagctgggctctgcccttgctctgggaatcacctgggtaaatcctttaaccctttcctgccccaagtgtgagctgagagcttgccagaaatgcagattccgagtctccagccctgctgagtcagaatctgctttgtaacaacttccccaggtgagctgggtgcctgctcacttcaacaagtgctgcattatccttttttgactctcaatttcttcaactataaaggtggtactgatggcaaccagctgccgagcagctctctcccaggacagttaaatgggccaaataatctagtgtgtgtaacaggtttcataaatcttaatattgtatttaaattatcatatgatagaagggtgatgtgactgactccaaacctctgcatgtgaaccatcagaattatccattctagtcatattattctaacaagccagatgcaaggaaaatcacagtctcttgtgtgcaaattatcacttattttttgtaagtactggattttcaaaccaagtatctacctaacagaggggaagggagatctagcatcttttacttcaagagcacgtctgtcactttgatttatagcctttttggtccctggtccagttcttttgtgggttttccattcaaattctacattagtttgtttaatgtcaattaaatcaaagctttgtgcaggaaggaatgaatcctggtacactccccagcgtgctgttggtattctctacataacaagataataaattaatagatataccatggtcttataacataatgttctttttctttctttctttctttctttctttttttttttttttacctagaatagcacaaggcacaaagttgatagccctcaaacttctgaagaaaagtcttttcttccaggatgtggaatccataatgctttctatgttaactttccctaaaaattgttgaatttttcataaacttctatgaggaagtgtttccatggcagtctggctaagaggttcacaccatcattctgtcctggtgatttttgaaacttacaagcccaggttgaaactcaggtgattcaaggcttgagaaacacaaaggccaagctcaaggagtagcaaagttgcttgcactttttttctattggcatggtccttctctgaacaccagggaaggggtggtgcaccacctctctcctcttcagaaggagctccgtgaaaaatcggcagttttatgcttggccctttcaaaacacacaaaggctaaaaatacagtgtgctacgcatctggaatgtgtctcatctgtgaatctctgacacatggattcattgttttcgataaaattccaggaattttattcatgagaaaattctggcacaatggaaaaccctggcaagcaaaagataggggcagcagatgtcctggcctccacccacaactctgtctctgcttttagctaattttcatcaggtgtcactctcatgccttcaaacactcaattcaaaatttcccataagacgggggtgagggggtgggggtgtcaaaacagccttaattttttaaataattggtacggtcccccccctccccacagacaggtgtgtcacaccaggttcaacatgcacgtgccaggatgcaggatgggcactttaagaagaagccgcaagaccacagggccactggccatggggctccaccactccgtgcccctcatgtaccaagtcttcaagctcctcgtctaaaatgagggtctggtctactgatgttttctaagactccattttgcaccaaaatgagatcgatttgtttaactagtaacatcctctttcagccatagccaggctgcagtctctacctcctccatctctgagcagacatgcagataaggtagaaatctaccatgtatggagttgctaaaaagttcctatgcatccaggttagatgctaactgcagggtctttccctgctgcccccagactttaattttcctcaatcttgtaggtatctccttctgtgctaatggtaagaagctagtcagcaccctgagagctagtgttatgtttttaagtgtggaaaggatctactctcttgcatgggaatatggcatctgttctacacataaagcacttcaataataataataaataaaaaaatttaaaaaataaaaaacacatggcaacatggtaataccaacagaaagtcttgtagaaactggggttctggcagacagaggagcacatgaataagtctccactattcacatgatggtccaggggtctccttcttttgctttctatccccatccccatcattgttggcatgggccacacactgtataacgcagacatgaacacagacgttttctttttcttagacgctgacttacgtagaaagagttagtcttcacccactgtgagggtccaatccctgccaaggtctttcttcagcttggtaagtgatgatgtctgactccctggggctgggatgctaagcctgtgcttttcagaagatttttccagcacataaatatatcctggttgctgcatggaaaggggactaagtagccaggtcatcagagccctttgctaatgttatacgctgagctcatgcttttcctatgacatagatgagcactgggtagaccccgtcctggtaacacttttcatgcactaacaagttggttgccagtgagacttgatttttatgactctgggagtgctgacctcaaaacctaatacatttgaactaggagagcaatccctccaacaatttcaaactacacatacttacatcacatccaatagggctcttttgccatctggcttgagcccctctataaatatgtctactttgaaagtcacaagcctgggcggggtggctcacacctgtaatcccagcactttgggaggtggaggcaggcagaccacgaggtcaggagatggaaaacatcctggctaacatggtgaaaccccatctctactaaaaatacaaaaaattagctgggcgtggtggcacatgcctgtagtcccagctactcaggaggctgaggcaggagaatcgcttgaacctgggggacagaggttgcagtgagccgagatcatgccactgcactctggcctgggcgaaagagcaagactctgtctcaaaaaaaaaaaaaaaagtcacaaatactctttgaaagtgtgcagagtcattcatatccaaaccatcaaggcctgcccaacagcctggtgacttgaaatcttgacgtgtacacagagtctaaacctcggtctttagattgcctccttactggacctctttacttattaagattcatccttgtggaggaagtgaggtcatggatgttcacatctatctttcccaggaagaaaaggaagcttcaagagctgggaaatgctatgcaccactgtgcaggttctgagcagcacagagccacctgtggggtgggcgggtaggtgagtagtggacatctgaccaccaggcgctgtgcaggactacctccttgcagagcaggtggggccttccaagttgcctactcatccaacctgcacagtaagccttatgggagcgtcatggggctacgcctacttcaaagagcaacttagctaaagggaaagagaatttgcacttgctctcttccactctagcagacttgcacttgtcgctatttatttgtgaacacagactcattttagattgacttaaaaataaaaaaaagtgcaaagaacagggcagctggaagttgggaaaccacttctgccactgctgaatctgaagccttaagctcctgaactggaaaaccagccgactggagcactgagctccctgggccctgtaaaagagcacactggccaggcatggtggctcgtgcctgtaatcccagcacttttggaggccaagacgggcagatcacgaggtcaggagttcgagaccagcctggccaacatggtgaaactctgtctctactaaaaatacaaatattagccaggtgtggtggcgtgtgcctgtaatcccagctactcggtaggccgaggctggagaatagcttgaacctgggaggtggaggttgcagtgagctgaggttgcgccactgcactccagcctgggtgacagagtgagactctggctcaaaaaaaaaaaaaaaaaaaagaatgcaccaagtagtggccagtcaggctcccatgggccttgacacgtgagatgtcaggcagaatttttattaatgaatctgatgccaattcagtatttctgcaatcacaatgcactttcgcaatatttatccaagcaatatttatccaacaaaaatatccaatatttatttatccaggatctcgcaaacgttcagtctagtttcactcacgtcagtgtctctaaccttcatactttgctttcaagcaagagtcgtgtgttggtctgggtgtccgaaggtgggggtggtagctggtgatgcaaggaaccaaaaattggccatacttacttacttaaatatttcacagctctttaacagattctcatctcctgctctcttctcttctccaaccttgccgtctggttctgacactgtcctgccacgattaggagtgagctttttggggttccctcaaacattcactcccagctggtctctttgttacctactcaagagcagttcatactgttggccactctccccttttttaaccctcttttctttggcttccatattcctgctattcctcctatttggttgacaattccatcccccatctctttatgccctcctttttctctcctcattctctaaatgtcagctttcctctgtgcactctcctgggccacttctctactaggctatcatttcttccaagccatcactcaggagccactccaatggcctcagcgctgccaggaagcgcagcgcatttaatttgaagggtgaaactgccttggagggatggcaggtgcatgcttaataacttgtttcccaaggccacataagtgtcattactggatgataattatcagctcaagagggaaagttctaagacagagaatgcaagatttctaaacaggtctaagacagttttccaatgtaagatttattatgtaacagttttgaaagtagtgtctgattccctgtctatatcctccagaacaatctgagggcatggttgccattacaatttactttgggggacgattttatagcacgtcttcacagacaacacgacaaacatctttgcttctgctacactgacaacctgaagttaacatttctgtacctatgtagccattttaatcaccccctaaactggttattccacagcccaggggtgtgggactgagtcagatgggctagagatacctttattcagaggatttagaagtttgcctcagagaaaggccatttctagtctccactagaaatcacacatatcttccaggaataagaatattctcttagtcataagttcaacaaatatgtactgaacaccttttctacttagaaacttgtctagctgcttctagattacatccatgacccaaaaccacaaagacacctatctgcataaggcttgtattctagcactacaagccacagataatttttgaaaatcaattaatcaaccaataattgatagggtaaatttataaccttgtttttcaagcctgatctcagggttagaaggtggtaagtgataagtatgaagaaacagaaggcagaactagagactcaggaaaagagaggtaaactgctgcttttcatttagagtggccagggtggtcctgagaaaacgcgaaggaggggagggtgtgagcccccatgcattcatgaagaataggccttccagccttggcaacagctagaacaaggccagagtggactgcgggggctgcacgaggaacaatgggaccaagaacagccagggaggaggggttactggaaaggagcgaaagaaagaaccaggaggtgaaccaggaaaggctgggggtggtagagccttgcaggccatggcaggaacctgggtgttgactcagagagaagtggagtctctctagccgtcttggctaaaagcccgggaattgtcttcttctgtgttgcactaatattttccatctcataagggttctgcaaagaaaattctttctatctttaaagttttattattttcaaaactaaatgtgatgagaatgcatatattgcatatgccatgtgtacaccaaaagccacacctaataaaatgttacagccatcctttgtcccacatgcaacgggaacttccattcatcatcacatgcagaaactctgggaactgagaatctgtacttttcattcagagtctgcaaggggtcacggccattttgaaaggctttgactcacacaggaaatacctcactgaggctcccacccacccatccactaatagggcagcctttagggaaactgacttgtggcaactgaaaggaataacggcaccaaagtattcccctgccctgaaatctctgtttacctgtggaccggtgatgggtgtgaggctgtaggttttaacgagctctgaatggcaaatggcagacaatggtgtcacttcctttctgcttaggaaggagacgtttggaaaaactgttcactgctgtgcttgcctatggagaacctggattcccagagctctatctggtagaacgtgtctccatattaataagcagtgaatcctcttttgcggctgaattttcctcaaggaagcagcatgggccttattactgccttaaaacccaatttcaatattcgatacatagtctgtgtattcatttgctagggttgccaagacaatgtaccacggactgaggggcttaagcaacagacatttattctctcatggctctggaagctggaagtcagagagcaaagtagcagcggggttgattcctcctgaggactccctccttagcttgtggatggtcatcttctccctgtctcttcatatcatcctccctctatgcatgcctgtttctgagtccaaattacctctttttataaggacatcagtcccactgaattaaggaccaccctaagggcctcattttaattggattacctctgtaaaggccctacctccaaataaggtcccactctgaggtcctgggggttaggacttcaacataactcagggaacactattcaacccataccatcctccaggaaggcagagaatgtgtccctcttcttcactgctgtatctccctgcctagcacagtgccaggtaccacactatgctctgtaggtcagtgattctccggagctctgtaggtcagtcattctcaaagtgttgtccaggaaccccctggggtccccagacccctctaagggcaggcataagcagatctgagaatccagctgcctccaattagcccagacattaaagagattgcaaaaaatgcaaaacaatgccacttctcattaacattttcttggaaaatagagttacttttcataaaaatatctcatttgtgttaacatgcaatgagtttatttatttatttttattttttgagatgaagtttcactcttgtcacccaggctggaatgcaatggtgtgatctcggctcactgcaacctccgcctcctgggttcaagtgattctcctgcctcagcctcctgaatagctgggattacaggcgtgtcccaccatgcctggctaatttttttttctttttctttttcttttttgagacggagtctcgccctgttgcccaggctggaatgcagtggcgcgatcttggctcactgcaaactctgcctcctgggttcatgccttctcctgcctcagcctcctgagtagctgggactacaggtacccgccaccacgcctggctaatttttttgtatttttagtagaaacagggtttcatgatattggctaggctggtcttgaactcctgacctcaggtgatctgcctgctttggcctcccaaagtgctgggattacagtcatgagccactgcacctggccttgttattgttatttttaaatgaatttataagtaaatgtttcaaaatttctgtttttgtttctaccaatagatataatgcatatacacaatttttttttaagaatcctcaaccaatcttaagaacgtaaaggggtcctgagaccaaaagattaagaatcactgccgtcgaggttttaagcttggctaggacacagtctgtacttactgaagtaacccacagtatgacagtaataagacactttatgaagaacatattttcagtagctaagtgtcatagaaaaggaagcttgttagccatttcctcaagttgacaacagagagtccttaggaaaataattttttaaagccaatattgagccttccaagactgcacatggtgatatgttaaatttggaatttatgcaacttaaaaaactgagagtcgggggttggcatttttgtgcatcctaactgacgagtgctgccccagggctctctaacactgcacacagtctactaaagaagcaggctgcccatcatgacccccacccatcagctacacagcacacatctgcttctagatgaaccttcttgcaagtggcctgtcttatggcaaaatcaaggggcaggcctgtaaagcggaccaggaaatgagcagcaactgcataccaccaacctgttgccaagctaactgtgcttttctggatcagaggcagcttgagacactggtccctggggctgagggactgcagagcccgggcacagactccctgcctatctcccagtgtgtccatcttggtacacctggtgcatctctggattggcaagtggcactccccaattaatgttaagggccacttgttttaaatataaccagattattttaatttttaaatgtgtatcccatacttggacactgaaaggtcctccctgtttacctgcttgctggggtctgtgcttgggtgtctcattttattataaaacagagtctcaaaggcatttaatactaagatcaagtggctgggcatccatcatgtgcagagcaggagcctgatggtggtgaaggctcattctgcatgtggttgactctaggaactactttaacagaggggaagaaatacactgggagaaaggagcaggagattcgtcagggctgggggaatactggctccatgagggcagagacttttttctattttttctctttttcagagcctgtaagtgtccacatatcatgcacatgcagtgcgtatttgttgcatgagctcctggtatgcaggtgccaaatgtcatgctaagtgtgtcgactggatgacagaagaaggaaggagggattaaaggaactggtgtgcactggcctgagccttgaagaatggggtgtactgggtaaatcaaaatggtggggagcatttccagatggagaaactgcaaggaaaagcatagaagtggggccacccctcgtgagctggggagggcccagggtatgtgtgctggttggggggaagctgaaactgaggaaattcccattggatccatagcctggttctggtttccacaggcctgggatgccccgtccagagtttgactttcagtctgcacgtaatccaggctttgtattcccacttcccgtatcccctcactcctttttcacacaccctttttatctatgatgctactggggtcatgggttaagaagtcctgtcgtctaagcagcaagggtgcatcaaagcaggattttctccattgattccaaggtgtgattcagaaatggtaaaaactccgaacactaggatgagcactggggatgggttcatgttttttttttatgaaataattcagaacttattaagaattcccttggcaaaccaaattaaatattaaacaactatttgttaatatgttactattggattctatcttagaaaagtgtaattatgtgtaactgaactttttgttttcttgtggttgaaccctgaattaccatgccttctggtttccgtgtttttcctggggaataggtcatatttcttacttccaaagcccagaaataaaagcctcacacatccatccgtagtcccaaaggcttttctgcctagtacccagagagtaacagcagtgcttcaaactatttgtggacaagaagtcctaaaacatcagacacactgtggaaagcaatttcatttcattaatacaattcataattaactgcatttattttattgtctaaattccaactgctaacctatcatatcgacgaattctttgaagttgcctttattctacaggatatgttcatttttagataatgctatttttcatatactttaagttctggggtacatgtgcagaacatgcaggtttgttacatagttatatacgtgccatggtagtttgctgcacccatcaacccatcatctacattaggtatttctcctaatgctatccctcacctaccctcctaccccccgagaggccctggtgtgtgatgttcccctccttgtgtccatgtattctcttgatcatctcccacttattagtgagaacatgtggtgtttggttttctgttcctgtgttagtttgctgagaatgatggtttccagcatcatccatgtccctgcaaaggacatgaactcatccttttttatggctgcatggtattccatggtgtatatgtgccacattttctttatccagtctattgttgatgagcatttgagttggttctgggttcatgttttaaaatctcaatttgctccctagtcctaggaatgatcttctccacctccaaggaatgcaagccccagtgcaacatggattcttcctctgtaagaggctagactccaaataatttgtcctgtttttgcctgtgggatgttacaagtgtaccctgctgtctgtaattgtgtttctgaagtgttctatgtaagtaggtttttgttagttgaattgtactttaaatgtgccaatcaagttccccatgaaaagagatgggcacagagactttttgaaaaattaagcatcccaagagaaaagccgatctgaaaagactacatattatatgattccaattatatgacattctggaaaaggcaagactacagagatactgaaagatcagtgtttgccaaagattagagggagggaggggtgaacaggtggagcactgagggtttttagggcagtgaaactattccgtataatcctataatgttggatacatgtaaatatacatttgtccaaacccacagaatgtccagcaccacaaatgaacgctaatgtaaactacaggcactgggtgataatgacctgtcaatataggttcatcaactgtagcaaatgcactccgatggggaatgttgataatgtgggcaaggctacgcaagtgtaggggcagcaggtgtatggaaatcactctatcttcctctcgggtttgctgcgtactaaaattgctctgagaaataaagtctattttttaaaaaatgaagtattccaattaatttataagttttgccacacgtgcaatgacggccctaaccactttactttggttctccgatactgaatatgtcactgtgaatatctcatcctccttgatcccatccccatcaaaactagagattgaaataaggagatgagatggccctccctgaccgccttgtgcctttcagaggaggtgcctgggctggaatggggaggagctaaggactcctgtgggattctgatgctgggtgtgaaactgtctgcagttagcacggtgttggagagatgagtgctagactttgtatttctggggactagtgataaatgctcattattatttatataattttaaagctacgtttaaatttgtccccagtactagagactttaatgttatattgaaataatacataataggctgcaaatagttatattcttgtcttgttgttgtccatgtatcagcattcttgtatgaatgaaactagaaccaagaagaaaatccatcactacaataatggtccatacattaaaacagtttaggctgtctgatggtctggggtgtgtgtgtgtgtgtgtgtgtgtgtgtgtgtgatatagatatgtatgatatatatgatgtatatatgatttatatatatataaatcatctcatcttgctcaaaacaatatcactcttatttaggtaggcacactggaatatgattttaattaattgaaaagtacagtttgtttcacatttgcaggagtggtttaattcctacacagtgtactaagatggcctctcgtgggctcatgatcctggaagatatactcccaaagtgagggggggtctatgttggaagcaaaaataaaaggaatttaaagaatgacaggtctgggaaattattcttatggatggtcagttcttcatatgataaaatagttatgacaaaccaaacaggcacagtctcatgtatgcactgatttgcatgaaccaactttacagataattgattcagttggttggaactacagtttcttccaaatgtggacaacttacaacagggtgggagccccaaactgtgaagtcatgtgaggtcatatacaaactgaaaaacagggtttctctactggaatgataatcctaccatgttacacttttccccaaaatgaaatccaacatctttcacctggcgtaagaagcccaacatgttctggcccctagaaacccttacatcctgcaaagagggactagagcttgttactcttattagctactcttaaagtcacagaggtagttaatttggcaaggagtggctacaaattcaagacatgtttggatgtgctgagaatcagaatccaatctcggccctcaagtcatgggttaaagacttggttttttatctatatgaggtcctaccttgtagttcaagcagaaacatccaacaaatgaaagcagaaacaacatttgacagctcaaattcaaaagcaagaggcttgtcaatgcaaaagtcttgtgctgcaaatgtttcaagggaagtatccatactctgaagtgtgcaattgaaagaatgacctgatattcttgcactgttgcctcaaacaaacctccctcctcctagctagctccggatcttttatgcatcatatagtacatcttcccaaaaaagcaggtggaaaccaaagtgtgcaaaaacacacattttccaagaacaaatgcattatactagcaagttatgtgtggtggggctaggtgcttctgcgggtgtggaggaggaggagagaaagaagggtcaggaggaagtgtgttgggtacagagacatggaaataagaaacaggaaccctgaaagacacacccgcggaggttctgtaactgtacatgtgctcttgttaaatcgccagtttcagaggactcagatctgaggccatatagaaatctattaatttgcatcttgactttggggcttccagtaacagtaagtatttgtatttcaggatccactcagcagaaaggccatacatattcaagtcacataataaattggtgaattccaagtgaattgtgaataccaaaaaagaaaactgattatgtgactttctggaatatgatgtagaaattgacctaacaaaatgtatatgcacacttacggcatgtgtgcatgagggtgtcatttatgtacacaggtcatgtgcacatccaactcatggccatgcatgctgtagcctgttacccattctgggagatatgtaagcctttgtctttctccctccagcttcctgccttcttaaaacatttcactggtcatcaaccaatgattgaagctgggtgcagaaaaggagaaaaggtgaaaactcctcttagtccacaaggtgacgtgttagtgcttcaagtgaaagggctgtggtggagagccagagaaagcccttaggtggaatgagactgtggttcctataggtcggcaccttcctccccacccggcaggtcagctcatcaattgcacttatctcccagctgccacagcctgtctcactcctttctctctcctgttgggctgctaccaggcctggtaaactattccgtagctctgtgcaatagaaaatagatatgtatttctctgaatatagagagggaaattggagttcacatggaatgcatactgtaaacttatttgttttctgaaagcaaaaattaaacttgaaaggagcaaagcttttcaaatttcccatagtgctggcctcaaatcctaaagatttttttccttgacaagaatcatgggatgaattggaagatctggatgctccattcaccacagttgatgatgctaaaacccatgtgacagcagaggaaagaattgaacattctaaagtcccctctggcaactggaatgccaggggagccttcaccatatacctcatcaagccaccccaacaaacctgccatgtcggtgaaaagaccatgctcactatgaaaatgtggcttctgccgggtgcggtggctcacgcctgtaatcccagcactttgggaggccgaggcaggcggatcacgaggtcaggagatcgagactatcttggctaacacggtgaaaccctgtctccactaaaaatacaaaaaattagccgggcgtggtggtgggcgcctgtagtcccagctactagggaggctgaggtaggagaatagcgtgaacccgggaggcggagcttgcagtgaaccaagatcgcgccactgcactccagcctgggagacagccagactctgtctcaaaaaaaaaaaaaaaaaaagaaaaaaaaaaaagaaaatgtggcttcaagaccagaactctagccctttgtccaaaaaaaaaccatagcccccgagacccctgatggccttgacatgccactgggggtccccttatctatttacattatagaagggcttctaagaagaatggtttcagtcagagaatccaagcaacttatgctaaagtccagcctcatcctcagaactctgggcatgcttgtttttaatgccatgtctatccatctgtgactcattaacgcacttagcaaacactgagtgactgactagtctatctctccccgtgataaaatttaaacgcctcttacaagacatgagtagtctacctacctgttacttgtatgccattacctgaaaaattcccatctgtttggatgcaaacttcacagaaactctgccacaaatgctcacgaacaccatcacatgggctgggctctagtgctttggaatatcctactttcttagaaaaatcgatgagtacatataaatataattagctgcaccttgattcctgcggaatcattgtattaactgctttgggctattctccttctttcctttcaggcaatattaatttgtaacaaacacattttatgatataataaattatctttcattttttactatcaaatacatggagaagtaaaaaaacaaaaaacccagaacttctaggcagctcttaaacaagtcttgctgttacttggaaaagtaacaaattcacaggtttattgtctatgttaataaagctgtgttggagtagtcattataaccttttacattccctcctgtttacagctcacagaatatgtttacacatgtgatctcattcagttgtaacatgatctgcataaattatgggtattaacacttgccatatttattacaacgatttccccagcaatttgtcttcttaattgtataatctatattgcaaacagatgtctgcagtttgtatatgcagctatgtactcctatggtttatgcatctacctcaggccattaaactgtaagctcctggagggcagggatgtatctgattcatttctgtatctccggaacccactgcacagctgctgaatggatacacatctagttacttaacctctgtgtccttcagtttcctcatctgtgaaatggctataatgattgcaggaacctgtcttctctgtcccaattgtattaagcaaaacacttaatacaatgtctagcatataataagcactctatgagtgttttctattattattattattattattattgttataattatctggagttaattgaattaaagttcaaaaagatgacctaactcatttgggggaaggtgatgaataaacggcagaaagaaaggaatatcagggatcttatatgctgatcctagctttgtctaatctgccaagctaagtcgtaagatttttctcttttcaaaatacttctgttaagctagtaaaaattatttacttgtaaagattccatgtgctgctttttctgtcataattgcatttaccttaccaaatacatattgaccatctacacagtggatagcagaggggccacagaaatgagtaaagtctagttcactctgcactggtatctcttttcttccatatttacattttataattacatttgtcaaactgcttcacaggcgaagtcctggaccaggaaccaaataaaattgacccagctttccgaccatggaaaactaaaagtataatcaactttggcaccattaaattctgtttcatttattttttccaagagtctattaacattgtcatacagaagtagaagatttaattgagtgtgtgcattttgagttgaaagcagatactaacaagaaaagctaacctggaagacatcttgtaaactgtttcatcagactggaccaggagccaggggagggtcgaggtgactcagggctgttggcaaagctgcagaaattgccactgggtttctctgtcctctaggcaacctaggctgcattggctctctggcctattattcattacggtttagttcaccacagaggttgccagtgagcagtgcataagattagagattttgtaaaaacatgttaatttgtatgaagacgaaaattggactatggagtttagtgataaaaatagataaacagttctgtcatttgatttaaatattaaaataagacaagacaaagcttttaaggaaatgaccacttcttggttctcaactagaggcaatgcctcttctgtcctgagcagatgggtgtttgggaatacgtggggtgacttgggttgctgtgataatgcaggggttctctggcaatcagagggagagggaggggcaccttcaaactgtggtccagatctacacaatcaggaaaggctgttcacctaaaattcaaccttctgttgagaagagcaacacttacggagctcatcaaagaacgacaaaccactggaacagttcttgagaccaaagtctcattcactctgggacatatccagttacataaatcatttatgttttatcccgtctctactttcccaagaaaccctgccacacattcatagtgaatatcaaacctaattaaagatcctaagcagctgagaaaattactcaatgaccaaactataattagtcttctacaagggagaaaatgtattcaaatcattgcttaattttgtttcatttcctcttacctgcacttgaccattaagatcaaaagtctgagaatttgtggccaaaaaaaatgaacatgagtcaaagtcacatctatttgttaataatggaaagtaattccttttctaattacacgtgaaaatactagtatccaacaaacctatttgtggaaaatacggtttagattgggaaggttaattactttcaggtttttcaatgtccaaaacacacctcagaactaacaggctcagacaagatctttatgagatcactggatcctccctccaaaagcttccccctcccctgttgatctctattccatatgctgcttcatttgatcgtatagcgtgtatgatgagcctgaatgcgggcatttgttgatttgagtattacctgaaacaaaagatacaccagaatgtaaaacccaggagggcagagactgttttcccagaacctagaacaactcctggcacataccagatgtaaaatcattgtagaaagaaagaaagaaagaatgaaagaaaggaaggaaggaaggaaggcatgaaacggtgcactattattgtatgccaccttaagtcactcatagaaaatactgcatgccagcactctatgcaatgggtgttacactagccattatgtaaagtcaatgacgggattatacgctgggcactttataatttaataaacacccttcaattaccgtctcatttgctcctccatgccactccacatagtatacgggacatattttaggatcaccagtttagagataaagacagaggttgtgtccccaaagtttgcttgcgagtgtggtatttgtaacttctaaaactctaactctcccctgaaaacacgtcctaagagtggtgaggctcccacgtgaggtggcaatattggttacccccgctgagctcatcacattgcgcaggcctccacagggcagctacactctacgataaggaacatgaagccctgagagtcaggagggagaaaaaagaaaatgaacgtttggaaaagggcattcccaaatcacaggagaaggggaagaaacgtgtctcagctactaagtttctcttttccatgacgctcaaagcagaaaatggctgcacgtgggcaattcgtgcgcttggagctcagacctgcagtcttgtcgtttgtctgccctgtcttggtgcatgctgggcctgacttttttatttttccatttcaaggagccccagcagggcctggaggaaatgagttttgcagcccatctcggcccttgagcttggctcctcggctgacctcggctccccgcctgcagacccggcatgaggcaggcagcaggcactgcggggcagaacttccgggacctgcaagaccagtccgctgccttctgagacgtagttctgaggtgtagcaagttttcattttcacagcataaaaccgtctacaaatacatacttcaaaatgaaatggaggatgcgctcaaaaaaaaaaaaaaaaaaaaggcttagagacacgtcaaaagggcacaggagctcagccaggtcaaataaattcccaaatttgactcacatcacttcagcctcatctggatattacccacactctgcctaggcaggcgaagcttccgtgggatcctctgtctttagtgaattctttcctttatcttgtccagcttttcattgctctttcagaaactgagcccatggttttaaatcttaatatgaccttgcattcaattatatatatacatatatatatatatacaaagctgttttttaaagacaattttaaataagaaaaaaataattattttagataccagagagtggtgaaataataatgattcaaacttaatcctcacttcacgtaggggaaattgactcaaatctgggagcatcaaaaattaagatgcatttacaaatcctaggagaagatatcctttgtaatctcagagaaaataattgagagagggaaaattttttttgaaagacgtggtttggacatattactattttgtgaaatgaagttaaatgtatggtacagatattaaagttcacttaagttttatctatataaagtgtgtgattttggatctaaacaggcataaatatatatatgtgtgtgtgtgtgtatgtgtacatgtttgcgtacgtatgcatgtgtatgtgtacatgtttgcgtatgtatgcatgtgtatgtgtgagcgtatgtgtgtgtaagtgttgtatatgtgtgtatgtgtgtgtatatgtatgtgtgtatataataggaagtaagttggaaaacatgagccaactgacttttttttccttagacagctaaagaagagtggttagaagtttactcacaagtaaatcttttaaggagcgtttacttcccagaaacagcaatgagatcttggaggggcaattcttgtcaactgtgcatcatcaatggagtttaactgtgagaggtaaaacccattgttggtcccgactccaccaacccaaatggtcatatctgaggacttcctgtggttctcccgcccccaccctctccacggcatttactgctcctgtataccctggacttctcgacaggaaatggcaaattcctcagtaggaaagccaagaagtgggaggtcacatggagactggaagttcattgcgtgcagcccctccaggtgacaggcgacaccgcctctgcatgttgagtgcctttgtgacacatgatctccttgtctcatgaccacaggcagcagggtcctgatgagtgccctggagagaactgtcctcccacccctgggtgacacagagtctcagaagccagcagaggtgctgcaccaaaggctcagactttcaccctgcctctcttctcctcaactctttgccctaaaaaacatgtgctttgagggtgtgttgaaaatctcactaagtcaaatgatgcctgtggggcagaaataacccttgctctgaaagggtcaccaaaaagtcatgagactcctacctgtatggaaggtggtgactatatagcccttgtataaacaaacaaatacggtgaaagacttggctccatttttttttttttgtctgttcgttattttttggagaaaacgttgtgataagaagcctttagcctacaaaaatgtctctagattaatgataatttatctcacttttctcagtgaaacagatgaatcaaagaaagtgaagcatcgtagacaatataggaccttcctgataacatctaacatttaataacgtgatcacagcgtggcggctctaaaagacatgcacatgtgaattaatgcatctaacctgcacactagctaccattatgcccattttaaagatgaggaaaactgagactccaaaaattaaataagttgcctagagcatcttgccagttaatgcaccagaattctaagccagctgcctggttccaaagcgcatgcccataaacgcggaacataatgcaccaaatggcctagaactgaaacgactgcaaaaataagtcaacatatgagaaactagagaatatataaagccagccccaccataatcagtggcaagggatgggagatgggaagaagggagaagggaagggaagctaaataatttcagtttttctctgtgcctttaattcctgtcccctgaagatgacacgctcattttagtagcaacccatgaccaagatgcattccccaagcttttcgcacctgacagaaagggactcggtgtccaggactgtgcccgattacaatcaaagcagatggacccttccttagggtagggctgttcttctgacagcctcctctgtgaaactagattataagaggatgtgctgctctcagacaccctctgcctgtccccgccttggggtccttgcctttgccattcccctggtccgcatcactcctccgaggcatttgcaaaccttgttctcaccttttctttgggtctctgtctgacaggccttgcctgatcatgttctctaaactagaggtcccgccccccggccacctggctctatcatgttccctaccttccctcctaaggctcctgacttcctgccacactctgtcttcgttgagctgtgatctatttgtcagtctcccccatctgcatccccctgattgacagcactgagtgagcccagctgtcctgctgctcatgcccctcagcacccatgagcctagtgggtgcccagtaaatccttagtgagtaaatgaatgagtcaatttccacacaccaaatcccaaagggataaaaagacattgcctttctgccatttcttggaagaattttttgagacaaactaaagaaaggaagctacttgttattaaatttttaaaaatctgcctactattttcaggcaaatatgtcatgatgacatctatgaaatctctgaaattaaagagaagcctgacgtttcacaggaattaaatgaagttgctgcatcacaggtgctccctgccacagggctccgtgtggcagcagcaaacagaactcctcgctgcttaggtgtagtccttaggaatgaaaatctgaacgtagtacgttaaaaaaaaaaatcttcaaaagcaaacaaagccctaagtgtcgctgtgtattatcagggcagggtcctcctcagagagaggcgggctgcaatcgcccctacacctttcaccaagtgcctcgcttcaggggtcccattgtctccacgtttaggtttaggagcctggctcttcgtaacaccagcgaaacatgttctcctaaagatgttccctgagatacaacaccactccgcattgtttcaccacataccagcattaatatcccagagtaatccaccctcctcttaacggctgatgacggctccaatggccatgcaaaaatcagttgaaggaaagggaagtcttgtcggaaatgagattagtcttgtaacgagtgttcagccctgataacccatctgggcacagaactgcttaaactggagagcaattaaccttcacccgacaagctctgtccaaccgttataaacattaaagagacagaatccttcccccctccttgtagactaaacaaccagatttgaaattccacgtaaacggcctctttctgcagatgtgcaccaacaacaacgtttagggggaaaaggtgggcaatggctctgttcataactctggtaacttttggccttggtgtgagtgggctgaggttattagcgtaaaaattaactggaggtatttccaataaaatcaccaggtttaggggactggacatagttgctttcatgcagaaacccatgtgtcctataggaacacaacttgatgcttgagagattcttttttcttttctttctttcctttttttttttttttttttttttgagacagagtctcactctgtcgcccaggctggattgcactggtgcgctcatggctcactgcaaccttgacctccccaggctcaggtaatcctcctacctccacctcccaagtagctgggaccgcaggcgaaggccaccatgccccactaatttttctgttttttgtagagacaaggtttcaccatgttggctaggttggtctcgctcaagcgatccacccaccttggcctcccaaaatgttgggatgacaggcgtgagtcactgcgcctggacttcttttttcaacagtagaaatatttgcactgggctagactctcactcactcccaattcctctcttccgacatttgcatgagtgatgctgcttgtggtcacagaagggagattttttttttaatctccgagaagttattggttttcatggggagcaaacctgtgatcttgcctttatcagcatttgccgtaaccagtcgagttaaccaagttgggccatgtgaaataccgagtggttagagaatctaccaggaaacctactgttaaaaataactttcacaacactgaagagaaatagctgaggtcacttaatttatcactcaggcatgagctttctttagcatcagttcatgctgagccattggcttgtttatggacatgatactaacaataaataggtaaagggtaagggccctatgacatagagctggctacaaaccaatgtggggtacacaatatgcctagcatttaaacaagaaaaaaatgtaaagtacatgcagaaagtcatatgagggaaccaaacctctatgttactgacctgttaatgtgactgcaactcagatttttttaaatagaaagaaaaaaggaaaacatatatttagcatgtcctaaacaaatttatctccccaaggttttagtgcaatcttcatgatgacctgagatagctatcaaaatagtccatcctaacattcgatcttatctctcccttgaacccagtttctctttttccagtaggtaagtcataatactccaggcctcagagacgtgtttgcacacaacgaggctgagcctatctcacttataaggatgacatatctcactcatgctggactccagaccggccccaataacagttttggagagtggcatggtagaggatgtgtgttacatgggaagtactactgtaccctgggacaagatatcctggcaacaggtcttgttttcatggtttgcatttacatgcttaactgttccttttcctgcctttgtaagactaagaaaatccttactgtacagagaaggaactgtgaaaatagagcaagtgggactgactctcacattgcagggatatgcaccatctccatttttgcagccaaattagatgcaagcccaggattccactggcctggttctcccaggaacactgggagtttcttggtgtcttagcttgaggtgaggtgaagatgggctatgggcacgtgagctgaccagtttttcatcctgtgtgcattggacgtagacaagggcacacacagacatgacaagaatccatgacctagctcctaatgtaaatcttctttcccaagacaatcttgcagagccctcatggtcagtgataagaggaacttcaatttttatttggaatctgacccatttcataagaatgagtaacacctgaatatttaggtgcagatatcaaagacagaagacaaaaagaaatcatagtgtttgacaataatattagtataggatgccgttttatgagttcagtcttaggactgtgtaggtgcaacgtgaagactttcctgaagacagccacatgaatcatttttcataggatgtaatcaccactgtcatccattagtccaggcttgacacatagaatgggggtgactggctgcctaagtaacaaactccccacgtgtgcttctgacgaactgtgtgggctgccctaagcttttgcatgtctcgacacttaccaagtaaaatgatgagataaggaaaaccacaacatcatactcagtatcttgtgaaactgaaatggttgcagagtaaacactttgccttacagtgattttattttgactattatgctggatttaacaatataatggttaatatccatgctataaagttttattttttcatcaacaaaactaattgcattggcactttcaaaatgttgtttgcacataaatgatttatacttaagtatgagtgtaacaatcttgccatcaggacctggtctgttgggagatatcagtgaatggagcctggctcttccaatgggcaaccgttgtttgttggtgaagctgccacccttgagacctgcctggtctccttcccacctgtagctggctaagtagtgtctccccacaattcacgtccacctggaacctcagaatatgaccttatttagaagtaggatctttgcagatgtaattaatgattaaaatgagatcatagattagggtaggttctaaatccagtgagagcatcctcataagaggctgagcaggacacacagaaacataaagaagaaggtcgtgggatgacaaaagcagagacggaagggatgcatctacagcagtctccccttatccacgggggacacactacaagacccccaggggatgtctgaaacctcagacaggactgaacccaactgccattaactggaacactttctgttccatccacaaatgcaataccttttccatcttaactaagcacttactatccactgtggtcatcagttttgcagtttgaggtgcaacggcaaaacaagcacagatttctttttatttcttcaaacttcaaagacagaagattcattcttactgtacatcttagcaaccacagcatatgatctttttccttgtaagtacagaactttcaccttttcactgaaagaaagcactttacggcttctctttaacatacccggaattgccaggatcagtcctcttgtgccttggggctactactgaataaaagaagggctacctacacataagcactgtgataccgtgacagtcgatcccataaccaagagggctactcggtgactaacaggcaggtagcatctgtagcatggatacggtggacaaaaggggaattcatgtcctgggtggagcagggcaggatggtacaagacttcatcatgctacttagcatggtgaacaatttaagacgtatgattcatttatttctagaaatggccatctaatatcttcagacagcagatgaaactgccagaaaccatggaaagtggaatcgcggataagagaggactactgtccaagccaaggaacacagggcttgcaggcaacccccggagctggaggaggcaccagatgcatccttcctcacagcctccagaagggaccaacccagccaacacctcgattttggatttctggactcccaagctataacagaataaatttctcttgctttaagccactaggttgtaataatttgtcacagctatcctgagaaactggtaacagtacttgtggatgctgtttttaacaaaaattttgccactttagggcactatatggcctttttttttttttttttttttttgccttatagagttaggtcaatttccaaaagtgctggagtttatgccaagaattaagtgactccctggttgcagtggccaaatagcctgaaattttcaaagtaatactaattttgcaaaacttttcatgtaaactcctttgcctgaccatgccctaatttttgtgattaggaaaatctggctcttatcccactggaggaaaagtgtctagttcatattctaatggaaatcatcacttgggaggtgttttgacaaacatctctcagttttgtttaaaaattatgttagaaattaagaaaaataacgaatggaaaacaaaatctaatttttggtatattttcctgctaacatttgtgggcaaattagttaaattatgattgtttcatgcatacttactcctccaacagcatcctagctctcttaggagttccttttaattatcctaaaaacagttaagagtatactgagccaaaatataattaggttgagaaacaatgaactcctaaatgaccaatcaagttttttccaacattttaattctcaaataaaggtcatttccttttatttgactccttaaaaactagattatagttcttctaggagaggaaccaagtcagatttcttttaatcacatacattgccaaatgcatgctttactcagggaaagatttcaatatgcatcatttattcatgcattcattcattcaggaaacagagtagcactttacatgcggacgctgtggaaacaatggtgatatgaattcttaaatgattaaagaaacagtccactaaaaatcttatcaagataatagaatacttcagattttatgaaagattacattttcattggcctatatataatgttttaaccagtaaggctcactaagttaaataatatgctggataatcttaaatttacagaagggttttcagttttactatttggcttagataagctggtagttacttgctaaaattaatctttattataaagcagatcatcttgaaactgaatacaaaaacaaacgtagctattattgaaaatgttatgctatctcatatccattagagatgttatttatataataagtactgtgttgtaatttgcctgattccaatgaatacagaaaccctcagtgtgaatcaatatactagacaccagcagacatatttaaaagattgctacagtttcactgacatttcaaagaggtgactgtagtaacaaaagaagaaaaatgaatagtccctatcatagcacattaatacaacttgtcactagttcatgtccagaaagacttattatataatagattgtcaaagttgaatatttcaatgacccaatgcaaatcctggataaatgctggtaggtgttgctgctcaataaaaatgaaagtggtgtttggttttgctcatcaaggcaagtgtcatgtagcaaaatgcaggctatgggttgcctggaaactgtattcctgcttttaatttacaagtgaaacattcccatccatggcctggaagggaccatcatgtactcggcagcactcattagattctgggcagcccccggtcatctgaccttcccaaacatagggaaaggacgtggatagacattttcccaaaaagacataataatgaacaatgggtatacgacaaggtgcccaatatcactaatcatcaggaaaatgcaaatcaaagacacaatgaggtatcacctcacgcctgttcagatggctatggtcaaaaagacaagaaatagtaagtgttggcgagaatgtgagaaaagggaatccttgcagactgttggtgggaacatggaatgttgcagacactgtggaaaaaagtatggaggttcctaaagaaattaaaaatagacctaccatatgacccagcaatcccttttctgggtactttcccaaagaaatgtaatcactatctcgtaaagatacccgcagtgccatattcattgcagcattactcacaatagccaagatatgaaaggaaccaaagtgtccatcaatggatgaatacataaaataaattgtggtggatatatacaacggaatatcatttagccttttttttttttgagatggaatctcagtctgttgcccaggctggagtgcagtggcatgatctcgactgactgcaacctctgcctcccaggttcaagtgattctcctgtcttagcctcccacatagctaggattacaggcacccacgaccacaccccactaattattaaatttttagtagagacgggctttcaccatgttggccaggctggtctcgaactcctggcctcaagtgatccacctaccgtggcctcacaaagtgttgggattacaagcgtagccaccatgcccggcccatttagctttcaaaaagagattctgccaattgccacattatggatgaatctggaggacgttatgctaagtgaaataagccacacacagaaagacaaatactgcatgatctcacttatatgtaaaatctataacaaacaaacaaacaaagactcaatggggaaatggggagatgtaggtcaaagaatataaagtagcaaatatgcagggtgaacaagtctagagatctaacgtacaccataagggatatgcttaataataccgtgctgtgctgtacttgggatttttgctttaagagtagattttaggtgctcttgccccacaaaaaaagaatgtgtaaccatgtaagatgatggatatgttaatttgccttcactatcagaaccttatcaccatcttcatgtatatcaaaacatcatgttgtacaccttaaatatataaaataaaacttttaaaaaataaatcaaaaagtcatagttcaaaccactcttttggaaaagtatggatttgttaatataagtggtatataacaattgtatatgcatctggggaaaatggactccatctttcatgatataaaaagcaattctcggccaggcatggtggctcacgcctataatcccagcactttgggaggctgaggcaggtggatcacgaggtcaggagattgagaccatcctggctaacacggtgaaaccccgtctctactaaaaatacaaacaaacaaacaaacaaaaaatagccgggcatggtggcacacgtctgtagtcccagctactcgggaggctgaggcaggggaatctcttgaaccccgggagagggtggaggttgcagtgagccaagattgcaccacagcattccagcctgggcgacagagtgagactctgtctcaaaaaaataaaaaatttttaaaaaacagcaattctttgtgattttaatatagggtgccagccacatcactgattcatgcactcactcatgcatttgtcatgcaggaagttatttattcatttatgaaatggacatttactgatagcctgctttttaataggcaccatcagcatgactgaaaggttacatgacaacagccacagaacttaaggcatagaactttaacaacacacgttttgagttactggtcttgacgcctggctaattttttgtattttagtagagatggggtttcactgtgttgcccaggctggtcgtgaactcctgagctcagacaatccacccgcctcaacctcccaaagtgctgcaattacatgtgtgagccaccgcgcccggtcggggttctatagattcttaatcatgattaaccagcaatatgataattcaatagatccctgctcacctcccctaaagaatgtgccactctaagtagttggttcaaaatagcttgactttttaacctctagatccactccagagaacagtggtctctccccattgcacaaacacattcatttatttaacagcatcacccaaagcataagaatgggaggaaacaatgaacgtccttcatttctccaactttaaattatcaaaactactgattttctgggctcacaaaaatgcagttgagttcagctgttgaaagtttggttaacatgtcagttgagccaccaaatggaataacagttgtaactctcttatgttttctctactgtcctcaaaggaatagcatgagaacaaagcaattagcatacattcaggagttgcataatgatgttttggacaatgacagactgcagataggacgagggtaccataagattataatggagctgaaaaatctctatggcctagtgacatacagctgtagtaacactgtagcacaatgcatttctcacatgtttttggtggtgctggtgtacaaacctactgtgttgccagttgtataaagtatagcacatacaattctgtacagtacataatagttgataatgataatagttgactatgttattggtttacatatttactataccatacttttcatcattattttagagtgtactttttctatttccaaaaaaaaaaaaagttaattgtaaaacagcctcaggcaggtccttcaagaaggattccaaaataaggcactgttatcgtaggagatgacagctccacacagattattgtccctgcagaccttccagtggcacagggacaagatgtagagatgaaaaacagtgatattgatgatcctgaccctgtgtagacctacgctaatgtatgtgtttgtgtcttagtttttaataaaaagtttagaaagttaaaaaaaaaatagaacaaagcttattgagtaaggatataaagaatgaaaatatttctgtacaactgaaccacatatttgtgtttcaagctaagtgagtacaaaagagtcaaaaagtttaaaaaattaataagtaaaaaaagttatagtaatctaatatgaatttactattgaagaaatgttttaataaatttagtgtaaatatacagtctttttttttttttttttgagatggagtctcgctgtgtcaccagactagagtgctgtggcgcaatctcagctcactgcaacctccaactccctggttcaagggattctcctccctccgcctcccaagtagctgggattacaggcatgcgccaccatgcccggctaatttttgtatttttagtagagatggggtttcactatgttggccaggatggtctcgatctcctgacctcgtgatccgcccacctcggcctcccaaagtgctgggattacaggcatgagccaccgcgcctggccaatatacagtgtttataagtctacagtagtagatagtgatgtcctaggctttcacattcactaaccactcactgattcacccagatccacagccactttccatcctgcaagctccattcatggtaagtgccttatacaggtgtacaggtgtatcatttttttcccttcttaataataataattattattattttgagatggggtctcgctctgtagcccaggctggagtgcagaggcatgatctcagctcacagcaacctttgcctcccaggttcaagcaattctcctgcctcagcctcctgagtagctgggactacaggtgcgtgccaccatgcctggctaattttttatatttttagtagagacgggatttcactgtgttagccaggatggtctccatctcctgacctcgtgatctgcccgcctcagcctcccaaagtgctgggattacaggtgtgagccaccgcacctggcctctactgcattattactatacctttcccacattttgatacataaaaaccattgtgttaagtgtcacaattgcctacagtattcagcctggtcacatgctgcacaggtttgtagcctaggagcacaggctacacttatagcctgtagcctacgtgtgcagccggctatgccatgtacatttgtgtaagtgctctttgtgatgtttgcacgatgaaatcatctaacaactcatttctcagaactgaccgggcatggtgatgcatgactgtgtagggaaatactttcacccctttagaagaagctataaataaccaggtataaatgcaggattcctttccaaagacaaatactggaaacaaacacaatcaaggaagataattgattacttcaaaaaaacaattgagatatgagagtaaattaaataagaagactgtgactaggataagtaaccaataacagcccataacagctaacattattattattgttgttattattatgagatgaggtattttgccaggttgcccaggctgacctcagatactgaggctcaagagatcctttgctttggcttcccgagaagctgaaactacaggcagctgccagcatgcctggtctgcaatttacatcttttgtacactacagcacgttactgttcaaagcacatacaagtattaagctgcttaatccttgcaacactaccaagaagtaggagttattatcatgactgactctcttctacagatgaggaaacgaggcacagggaagtgaaaggcgtggtgggacagggacctgcggtctggatctgcttcatatagagaaactgggttcttaagaaggaaaatgggccttaatttctaaatcgtaacaagttcagccctcactcctcttttttttttttttttcactatcctggaaaaaaaaaagaagtggatagaaaggtactaataacaatgagtttaatttctcaaattttattattctttaaaaaggatacattggtacaggagtaaagacaaaaaaaatcaaaaaagaatcgagtattcaaagacccttgatggtgtaacatcaattattttaattttgtttttaaaatttttattttctaaactcctataataattgtttttcaaatggggaaaaagaacgaagtttttattactgcctttctttctacaatatattattcaatggagatactgaacctgtatttgctacaggctaaagaaaataaaataaaacaatccctagccaggcaagggagattttcagagaggatgccaacagggtcctatcccatcaggcatccatgacaaatctgtctgctgtctggtcctgtagcatcacccaaatgtggttcaggcagcactggaaacaatacagactcaggagatcagggaagtcattttgcaaagaagcagaagtgtcaggaggtagcacctgtaaggatgaatgctggagctgtctcatggagtttcacagaaaggtaacaagctgcacaatgactgtctaggggcaacagatacataggaggaaagcagtcttcattcaaacaggatactgagattgacatagtgtgtcttccaacaagataagcaaaagtatgtgaagaaatgagtccctaaaggaaaatatctctttgggcaatttcacttcaattcaatttcatgttaaatacaaaatacatatattgaatatgtggataaaatcactagaatatattcgtgcaataacatctacgtgagacatgacagcatctcaccatgtctggcagtctctcggggtcaaatgcaatctctgccccccacctggcagtcatcggcacttatggaataggccaggcagaaggctctgttagatactgccttcttcccttcgcaatgcactgtcccagacttcctggggtgagagaagtgattgtctatgagagctagcttggagtgaatgaaaacagcatttaagaggctcagcattttctgatcgccaaagggggtacccttcaacatgaggtgacccagcaatgattggctgctgagttctttgagtattttagggacctgcaggagatctgggtggagctgtgggtttccgtgtgtacagtgtgtaaacatcaccctttggtgcttcgccagtgcttaaggggctcccaggtgctatttattttgtttagtttattgttcagtgttattgtttgttgacttgatctatttttttttctcctacaaaggggccagtctgcaaggacacatcctgtagatggctaattgatgatgccctattgtttagtgtgtgtgcactgtggttttatttgcttcggttcaaagggcctaaacaatgcattcgttggaatttagtaactgctgtaaaatcagcacagagaacaatctgtgagctgatattttttgtacccaaatctggtaatctctgcttgactaaagaaagcaaaatctaaaatgacctttcaactaaccatagaaaaggccttccattgaatctcaaagagacttatttttctaccaaatataaaaacattcgaattatgcatcattttccatgattcaaaggagacagaggtgcctacggggcatgttactcatagacaagtctattctagtctaatcacgtccccttaaaaatcaccgagtagatgacaccgaggatgagaacgaggtactgtaatcattactttagaaactttatatttttacctgtttcaagacagaattctcctagaaaatctggagcaacaagcttattccccttggagaggagataacgaataatggaccacgcattcggagagaggaagtttccactgggagcccttcctgcatcagtgcgtctctggttgggctggctatctgtgtaggaagtgaacgcaggaagtatctgtctacaaaccctttatcctcaaggtaattgctgtagcagcattttactgtttaccaaagcagtaaacatgtgatctaaaaaaagatgttttccatctccagaagaacaaggctttaaaaaatgtatacatgtgcttattttgtaaccagcttatcaaaattggttacaataggcttgggctttcaacagtgagtccatgaaaacagctcttgggatggacagaggtaccctcacagggatgcacaagaaacaaagaagtggcttccttcactagaatgctatcctagcaacacacattttatgtcttttctcctaagaccggcttaaccgagttcatactgtttggcttacaaagaaggtaaagtcaacaaaactatctatgttaattcaggttggtagaatgagtaattcacaaagtccaataactcataaaagtcacttacatttggccttggacaatattcttatttttacgtgactataaatatgcttccagtttaggagttcacacaagacaaagtgaaaagttagaactcaaaaggagatgtgtagtggctgcttttgctgacttttgcctggcgtaggccaagcctcctggtccgtcttttcctttgtttctttattccagatcaagcttgcaaacctgcaccgtcccagatttcctggggtaagagaagtgattgtctaggagaggcagcttggaatgaataaaaacaggtccaggaaggatccctcagcatttaagaggctcaggaggggtccccctcatcatccttgttgtcttttgtgtttttcaagccgccttccaggtggatagcgattgcaatgagagagaaagagtatggaaggagaataagaagaatagggagacacagaagttaacaacgccctgaatgtctccttccaggacctgctgtgcagtgtccggtgaactcaccagcaagcatttcccagccctgttttaagcaatctccaatgcagatcaggtgctcgtgaataattgggagctcactgtgtctgtcagagttcttactttataatgaagagataaaaacatgttcatcacaggaaaatggacaaattggctaattgaaaacaaaattcaattcacaaactgttgtagaaattgaaaaaaaaaaggtagggggaaatgcttttcatagattccctgattttagtcttagaagaaaaatgtatttggcttgaatgaatagtaaaattaactaactttgattgaggagcttatgtgtgccatatacagttctgggctcttgcgacttggtgaatctcactataaccctgtgaagtaggaactatcactctacccatttcaccgatggaaaagcctatctcctgtgaggctgtggcttgccaaaggtgaaatggccaggaagtagaacagccagggagtgaaccccaaaagccaggtgggagcccatttcccctgcccactgcacgagacccctccccggtttgaagatccgataggggcactgctgttagctccccctgcgtcctggcagcagcacagtcagcagatggtcactgtggagaaggcggagctgaccacctccattttcctataagggagctagggccaggagaggtgcgttcacctggggaagtcctgcagcatcaaactaaagctccgggccaccctctcccagatgggcctctttccacttccccttgccagcagctatatctatgcctcccatccgttgcacggaagataaggccaatcccttttccacagaggctattttaaggatgccacgaagaaatacagagtaccaagtgcctccctgggccaaagataaaagtgggctgtgctctctggattcaaccttcatgtttttgatgctctctggaaggtcagggaaggcacacatatcgtatggatccaaagaggactacgcaatgcaaaaccacatactttttttttctttttaacttggagcaatgtcttgggacatctacctcaaattgagacacaaactaattgtgttgacagattctaaagtgttgtttcaacagtttcttcttcctcaaaggtgagcatcatgtgcacactgtcaaaattaaaaaaaaaaaaaaaaagacccaataaaacccgatgaaacccaaagagcatggagatgagaaactcactgctggctgacgatctgaatgaatggccttggggggaatgtgaatgtggaggtagcagaagggtcctgtcttcagtgcttgattctgtatcaatacttggtaaatttaaaaaacaaaaaaaccagcaagggagattttaaatcatcaaggcagaaggatttaaaaagtggaatgtgttaaatgcaagagtgcgggatctttgcataaagttattatattttcaaaaattcgacaagcattgtttttaccaaacgtgtttaaagtaacagccctgaggttaatgttatgattggattctgatgtggcactttaaaaataaatcattttgcttggccttagcatttcttttcaaaatgtctctgtacttatctgtgtacaacagcagattaccgttcttcccagagtttaattccatgaacaccctgctgaaagacttgttaaggccttatggaaaactctgacctgcgtgttcattattgacgcccaagacgagtgcaaggaagttgatacttgggatgaggaaatttaaatcagcagctgatctggaatctggaagcactgccccttggatctcgccaaatatggaaagaattcttgtcactgagcaaatatagaattcagtgctagagttttacctcttgaattttctagaactttgttttgattagccacctagagtataagaattgctgcctatgggatttttcccagaagagtagataacataaagtaaccagcgataataattttcattatccaattatttcatgtgtctccataacacttaatacatcatgtttctctgcacagtaattcactatgtacagctagggtgaatagcaggaaaaaagagatcagatgataaagagaagggagacagatttgtgtgacttgtataagatacttcgcctctctaatcctttgtccttatctgtaagaaagcagcagtacccaggctgctgtgaggatcacatgagacattatgagagtttagcacaggacttggcacataacaagcagttattaggatgatgttagtttggattatgaattcaagatactacagctacattttttatactttcttaaacatcaatttaagtcaattttaattaacgttattttactaggagaaatgtctctaaaaacataagaattctatttgaagtctacaatgataattacattactctgatatcttaacttcctctttatgatttcaaataattaaaatttaagtttatgttttcaacaagtgcttattgaacctctactctttgccagtcactgttgaggacacagaagaaatggataagatatcactaaaaacagcttctgcgatatcagtgggtatacataaattattcacactcaacaacaaacacaagcaaagctgggagaatgtgctgacaggaaagaaaatgaagagtgggagagtggacagatgggaatcgatgtgaaattttataaaacatgtcttggccaagctcagtaggggaaatatgtggaaagtaagctagaccaaacagagaataaaagtataaataagaaaaaaaatccagaggtcacagtggaccactagccaaaatgggttcacagcaaacaaacaaaaaaatgtaatgaaatactaaaattaaagaagtacaaataaaaatgagattctgttcttatctgtcagaatggcaaagattcaaagagtaaaatattcagagttgttatgggtgtagtgtggaactggtctcatatgtggctagaaaaagggagaactggtataatccttccagagaataatctggtaattattttttaaattggcaaatatttaaatttggcaaagacttaaaaaatatatatacccattggctcaataattcctttctaggcaccaatactaataaaaagtattcaaaaaattaaatagatggtgtactgcaatataatgagtgaaacatcgcaagcagcatcactttatacactaggatattggttataaaatggtaatacatattttagatagaatataatgaaacaaaaattttgcttatcaaaaaatgttagtaacatgggaaaatgcttgtaaaacaatgctaactgagaagagcaggacaggtaggtagatacaaggccaaacagatacacacggtggagagacatatcccaattgttaggaatttgctgtggttggttaggatctgaacaatttatattgactttgtgatgacttttaaacgttttctctaccataagaattttttatgtttataatttatgctaaagaacaagatgtattttttgtaattcaggagtaaagaggagagtggggtattccagggtgctgttcctgccctaaccaggagcacgatgcagtcataggcctctgccctcctccagcagcctcggctcagaacaggacgaagccaaccctctctgaccagcaccacctcgggcgacccctggacgctccacctgcccctgtgtgtggtacctgccctgctacacctttaacaagcacccctgcaagctccctcctccttccttccctgtcctgtggctgcccagacccagatgtaccctgcctgggtgtgggaggccgcacatcagagcagtctatggctgtgggcttcacagctgaagctgggccgtgggaaatgttgagacgagtgagtgcagagcctgaaagacaatacggtagaaaaggttacatccgcgggggggcgtctgatggcatctgccatttattgaggatgggtgcgagacagggtagccattatgatcccattttacaggtgacgaaactgagatcagacaggctagctaccttgcccagggtcacaacaggaaggaagcaaatgcaagtgtgtctgcggccacgtaaggtgagagaagcgctatcaggggtggtctgacagaatccccaggccagggagcagttgtcctctatcctgtggggtcaaaggaggggacaagaaggctctccttgaggtagctccaaagaaaagaccccgccagagcacagtgtgctaccaaacgctggaacagcctggagactgtccctgtctcttctctgaggtttctcatttcagagaaactctcatccgtctggcttccccatggcccttactctgtgattctcttatgtatcagctgttaaaccaataaatccgccaaattgttgggatgcctataatggctttgggtctccactcccacagagggaatcttattctaaagttctaaatgtatcagtcatattttcctgaagacaacagaaatggttgtttcatttacttatttttatgtatgctttttcaagagttgttaacctgtgtttgtgtttaaataaagatctgttttgcaaaacaaaaactttatgagataatcacttataaacgtagataattaagaaatggttcaggctcagcacattgtctgagagcattgcagtcctgcactgtatttcatgggggaagaaaagcccacagatggagccattctcaatcctgctttccagggtcactgagtcagggtgcctggcatgcatgggtgcatgcacacacaggcagagggccagggagaactgtgctgtgtccacagagggcagcctggatcacagagctgaccaagaacggaagcagcaagttgttttaaagtagttgcctgtaaagccacttttcggcaaggacaaacactcagagcatgctctgaaatgacttatgcacagcagggcagcggcattttgcccctggccttccttccattctcccggaatccccctaaagtaacaaggactgacgcaattcgtatttcacttagccaacaggttgatgaaaaatcataaatctgtagctattaaactcattaatcacatccatcaaaattctgtgaggagttaactttcttcatataactcttagtcttaattaagtttccctcacatgtgatagcaaacgttcaagaagtgcaaatgtgcagacgtggcgtatataatgcaagctttatgtctttaaattaataaaattgagtcctatcaggtcgtgtttcaattaccatcaaaccttccaacctctgttaattcaaaaaaaagtaacttctttaggcaagtcatggaaatagcactagggtgccctcaggtctccaccaagccttgttagtaactttccatgtcctgtctgatttttaagatgctttcccctgatgctgctgccggctgctggctctctccacatccttcaatgtcagatctctgtgatgatggaaaatcccccacattccctttttacacattaagtatctttctaggatcagaacttgcaacctggggttcatgttctccttaaaaggtccggggagaggactgtatttctgttgtaattctatgtatttctttttaggcaccagaaagtattattctgagaaaggactgtaggcttcactagacttcccaaattgcagatggcattaaaaaaaaaggaatcaggaaagtctttgggaaattaggctaaaactcctaactgaagcacaatcgagttttcagtgcaacagcaggatccctgcagtctgtagcaaacactgagatgtttgtggggacagtggggccggtgaggttcagcacctctcaatattgtcagatgtcaccaatgcccaagggaagcaccaaaaccaatcagtgaattgtctgcaaaccatcagctttgttgcttccaagtctttactagaactcttaagctgatcttaaaattcacagacacttagagataaatgaacactctcacataagttcccaaaattcctttacttcttccaattgaaacattttgttcccaatttcaagttaccaagggaaaatgatggtaagaatcacaaagactggatacgaatatttagcttttcatagtgtctcatagggtcttacaaatgttaatgcaaaaaaataaaaactccactcaaatgcagaaaaccaacttaaaaaattcagagcatctgatacctaatcgactaattgatttatttactgaaacaacaaaaaaacagagtgcattgagactggaaattgcctctatggggggctgtttcctaattccagtggacagccatcattttccctatgctaacttgggctttgcgctaacgtaattgaaactgtagtcaacagactcaggacctcctttttccactctataaacaaggctgtaaaatcatctcattactttacccaggaaatctaacagaaacatgtcttaaaggaagtcacctataaagagggcctattttaacagaagattaaaaaaaaattcacctgtagtcattctaagggttcacttgggtacatacaataaacacataatgcaatgtaataaaatgttaaatcaagcatagtaccttagacaagtgtaaactattatttccaaaaaagtgttcagaaaatcacaaaatattcaaactttcaaaatagcttcatgtattcataaatgtatacttcaaattaaacagtataacacatttggatgttttgcaaaatgtacctaccttctaaaggatggtctgttatttcaatgtcctttttaatgcactgagttttttgggaaaaaaaaccacataagatcgtacccaagctattcaagatttacacagaatatttgatttaacatgcatatgaataaggatgaaaataagaacaaaaaaataacattttgggtcacaaaatcaagtaatttctattcatgtagctataagtagggcacattaactctcaattttataattcctgtctataggagccatatttcagcagattccaatccttgaagccaaagaaagaaaagtataaggtgaaagttcttggtacacagatttttaatatattattgaacacaccttgagaaataaaagctgaacttctcaaacacagtttctatggtacatatgagtcaaatcttctaatacaaacatttcaaattatgaaaataccaaaccaaagagtatttttgaaaatggcttggcccaattctgggcaaacttccattttcttatgcactttccaacaaactaaaagccttatgaaaacaccaccaaatgcttctcacctccgtgcagcaaaactaaagacatgcaacaaacacaattttcttttccctccactcagcatctgcttttgttgctgatttttcacatttctacaaatgtcacgaaggcatggtggcctttaaaacaactgaacggacccccattcaagactgcatgccccttgacttgtagtcaccattaaattggcttcatttccaggaatcaggccatatttaggattgtacctgtgcagatttacctccacattaatctctacatgctatctactaaaaacttaggcaaggaaatgcatcagaccaaacaccccacagcacagagaaccgaccggccattgctttccaatctccgcaaacctaaccattgctggaagaaatcttactcacagtgcacagacagtaggtattttattgaagataaacatatagtggaacaaaccaaattacccccatttgagttacgtgagcactcagttctcagcgtggatgtcccacaaatcaagtcaacatttgcgtcccattaccagcagccacttgccgagtatctcttcgcttccactgggactgcctggcatccctgatgctaaggagccactgaagagcctccaaatgtctgacattcacaaacgcatcttttgctttgacccgacccttcaacctctccgagtctgctgccttttctcagacacacatccaggcaccgttagggatagttagagaatctgaaaattcagaagcgctccgaaaagcctttccaaaagtaatccacagcactcaacagtgaatttagaaaccccaatttttttctgagtttgaagtttttaagccttgcggatggttggagtaggaaaaaggaaatttactaggcagtgcaaaggaaatcttgttgtcctctattgtggcagtgggggtgttgcccaaccctaacttatctgccttgataaaggaaaccaaagaaaagagtaacaagaacaagattttgtcaaattaaaaggaaccctttccttaccttaatagtgctggccataatgcgatcaagtttattgatcgttaataaatgttaataataattattgcttctctctgaccagaaagtagttttgatgaggttgtttagagcggatgagattgtgctaagtctgggaaatgaagtcagccaatggcaggaagaggtttctattggtcctggctgtccagcccaaagaaacaggatatttgggagtggagagataagagaccctgaaaacaatgttgtttttcttgatgatatgcagccaggagattttttttttttaattaaaaaaagaaaaggcatcaattgggatggggactgccacagcaggtgtgaccggtgtgccgccgtgtgacacactgcactgagaccaaggcaggatgcagatgtgatgggactccgcatggcttcacacgggctgcaagcaccttggagccaaggcgttgagggcaccccactgccctgggtgtcagcccttcgcagcccaattcttcgcagaattactaggacagaggacttgagctcctttctcctaaaaggaaactttgcaggtggagtttatttcatgttaatagatggccatgttcagtaacagccattgcctggctgatttttaacaacctatatttattcaacatttcatataagtgttccagaacagtttcattttctccttccaaatacctgcactttttatttgctctacaacaaagttgttgaaaacgcaaggactctaggcttacagtaaacacaaaaaataaagaggaaaaataaaccttcctaagtcttgttttcaagtatttattaaaacccaaataactgaagtgactacaaatgtcccggaatatcagtgagctggtctcactctgacagacatccatgttgcagacaacagatcctcatagaacttttggctacccagagatgccatgtgagggccccattacatgtctaaaatccaagctataagttcagggtcacaggtctgttttctcctcgaaggaagtacagcgaatgcaggcctgaacattccttagagggtttcaggactttaattactcattttcaggaaattgcttggaagaaacattttgctttgaatctagctacaggaacgcaggacccataaagaggtgtggtctcaataggcgaccccaagaacacaatagactaaatcctgagtcatctgacaattcctggttgcagagctggacgttcagtaaatggatttcactcagactttaggccggcatgtgtcagagttctgtccaccagcccaggtcattctggcttttattatatacctctgatttatcacctcatgttaggacaaaagaaggaggagaaggagaaagataaggggggaaagggagaggaaggagaggaggaggaggagggagggaagagggcgagaaaaaatggagaaggagaaaggaaggacagaagagagagagaaaggaaggaggatgggaggaaggagggaggaaggaaggagaaagggagggagggagggaaagaaagaaggaaaagaaaagaaagagagtatattgtaagaaaatcattctgtggaaatcagaacctaagttctcagcacctacattatgagggggtgttgatttccgctcttttcatctctgaacaatgaataagatggcaggctgattaaaattctgtttccccgaaaatttcaaagtcctgagctgttttatctgggcagcttccactagaattctggagtgcggaggagaaaagctctctcagcttccctgagtgtccttgctttttgttctctcctaagaagcatcaatgtaaaatgttaactgtggcctccacaacacatggcacctgattatgcctttaccaaacaccagctttaaataagatgaacgctttgctaatgaaatagccacggaagaaaatcctgtgtggtcccgcctcacccacgcctcgtggttgctaatccagccctcagttgttccctgcagcaggaaagatcagcatttctactgggacctaatgcttcagtgatgatttggccttaactccctggttcttgcctaatgcaaatcaaactgtgaagagtgggatttcttacctctctattttgaaataatttccaacttacagaaaagccacaagataatacaccaaactcctaataccctttgcctggttaactctgattgtctactggtgccaatgtacatcattttctctgctttctctcacacatgctctctctctctcaatctctgtctctctctcccatatttatttatgtataacatacatgcatgcatatatccatcattttctaactaataaaaatattgttttataagagacaaatttatttattggatactaaaaaagagaaaaacagatgctattatttgatcaatattcgatccataagttttactgcgtctaattttggaaatgcatacaaacataaaaagtgatctaataaaaagttaatttggggatactgagtggtaaattctgttccaaaattttacaaaggaaactcctcctcatttctaatgacaaaatgtttgattgattcctgttgtcttcaaagagaataattcttgatgtttcaaatggcatcatagcatccaagcctggtaatctctgactatttaatgtaaagtgttttaaaaaaatctttggctcttgataggacaaggcacatcttttttttttttttttttttttttgggacggaatcttgctgtcgcccaggctggagtgcagtggcgcgatctcggctcactgcaagctccgcctcccagcttcacgccattctcctgcctcagcctcccgagtagctgggactgcaggcgcccgccaccacacctggctaattttttttgtatttttagtagagacggggtttcaccatattagccaggatggtctcgatctcctgacttcatgatccacccgcctcagcctcccaaagtgctgggattaaagacgtgaaccaccacgcccggccaaggcacatctattaactagaatatagcagtgcagaaaccgtttcccaaatattatcctatggggaaattatctgaagatatagatatcactctagctttcctcacttgtaccccaagtctatgttattaaatggcctcatccctacaccacccagcagcctaagaaccaggctgcctttcccacctgatacctcctctccctagggaaatatgccctccaagccaccacgcggaccaagttagggggcaatctggcacacggcccctacctgaggcccgtcctgccatgagcctatcagggcagggtcctttttcactctccttgagatgcagtaatcaccacactagaccagcacagcccatacagtagctgtggacagcagaacctatgaataaagcacacatttcccttgcatgcttctctgccacaaacccatcccctgtgaatctgccaaaaccttccactagtctcctcacattttactccaaagaaagaaacaaaataatataacataaatataccataaattcactgtcacaataaaagaaacactagtatttatttatcctaaaatcatttcttcccattttctaaagatcgaacaagttctcattcttgttcccttactaacttctctgtatggaatatggggaggaaggttaggagctaagaacactctgaatgacagccacatggttctcaatgtaatacatgcgcagagcaaagagaggagatccgtctgaacctccacatctgtggggacacaacagaagattcactcatgactcattcacgtctttatccctgccctatacatccctacaatggaacgcccttcctcctcaaaaacattgcaggaaaatgatgtcgtagatgaacacttagcaatatggaaaactgctctgatattttacctggttagttaaaaaatcacagtatataggagaattatatccatagactcattttgttaaaaataaaaaggcagttggggatggccgtgcattctgttccaaagcatctgtgaacctgaggaatagacaccatgagcgaagctaaccttcccgagttgaaaaatgaaatgcaatggtggcagacatgtccaaggaatattatggggactcgatccctttatgaatcttgtcatagatgaatgtgtggagatgtcaactagttggcagcagaacagtattggaacggtggtaatacaaggaaatagtatcatcatattagaaactttggaatgagtataaataatggctgttcaacagaaaaacccatgtcccctctccaaagggcctgtttcactatatgtaaaaattaggtcatgtatgttttcatattagactttttgttaaataaccttttttttttttttttttgagtctcactctgtcgcccaggctggagtgcagtggcgtgatctcagctcactgcaagctccgcctcctgggctcatgccattctcctgcctcagcctcctgagtagctgggactacaggtgcccgccaccaccctggctaattttttgtatttttagtagagacaggttttcaccatgttggccaggatggtctcgatctcttgaccttgtgatccactcgcctcagcctcccaaagtgctgggattacaggcgtgagccaccacgcccggccaataaccttttgtaatagtcaaaaaataaaaaataaataaaaaggcaaagtaaaaatattgacagctatatcttataataccaatggcagagaagctttttgttttttcccctcttcttctttggttcacttatattttcaaaacataaatttgtaataaacataaattatatcctaatataaaaatatgtaagtaacatgcaatgttgttcatttttgtaaatatctgaaaaatacaggcatgttctgtaaaaagtgcagcccacaatacttgtaggtgtcaaaccttttagcatgcccaaatgcctgttcttttttaaatgtctacagcaagcatagagctctttttttttttcattttattaagaaaacccagaaacgctcaagagtttcgtggaggccatctatgcggcattaatccattcaggtgatattaatggccttttcctgccaggaactccagtgggcactcaggaagccaggattacagggctctatccagtcaccgcatgtctcggcattcgggaagcctatctcagtctcctcaaattctgcacacataaaacttcagagcctgggagcgacccatgaaacgcaggtttttaaggacaaaacaataggacaaaagtgctgtatattgtccttaagatgacacatgaatttaaaatgcatagtgtttggattattcatgagagccccgcaagaacgatgtcccaggggtttttgccaggaacatgcctgagattgtagataagaatcaagcatctggggctgccgcacaatggaaaactccagcactccatggaacttttccatctgcagcagtcggaggatttgcctgagaacatacgcggcatgaagacactctcagccctcaagggcacccagtcagcgctgtttaaggacggtttttctgttcacagcatacttcatgattacagcttcactccattggatacaactatgtgagtatgtgtgtatgagtgtgtgagtgtgtgtatgagggtgtgtgtgtgggggggtaggggagtgccatatcccccagcagcacattaagaaataatccaattacaatttaaataaccattgtttcaacactttctctaagtggtgaatgtattcttcagtctcttggttgatctgaactaatagaaaccaaggaaactgttatcacataccaaatcctcaacttctcaacaccaagttgcaatttccttaatactgaagcacacgtcagttcagttctataagctcccatggagcaatgatttcaataaacacaatttcataagcatcccacacgttctcaagtttaggccaattttgctcttactcaactccatatgactttaaaaatgcaggaatattaaaaccattatcaaggactccaaataggtcaatgtattatctgtggttttaagaaagaaacctaagaggagagtaattattttgtcaccattatttagcttaaaataacttttaaatgtattgttccaattattaggcttctccatataatttggaaaccattaaatgagtttcaacttctttgtccgtataactgggtatatctgagcatagatgctacagacatcacgttgccattggtgcccataaggcttcgtatgcccacagggcatataattaagattcacaaaagcatctgactggcatcccactctacccccgactcagatccaaagtatcctttcccaggtactgtcccctgtcaccatccttggccaaattgagaatttatcccaggttgttgaaattaattttgattttgattctagtcagagttttaaatgattttttaagaagtgtgtcaatctcacctataagatactaaacagcatcacttatttttgtcttaatctgtcactattttatgaattatttttaaagaaaatacagattacttcttaaagaaagatcataagtggcactataatagcattcaattgatagaaattgatgtagaagcctgcattaataatttttcctgctgctttctaaagttggcttttagttttcggttgaggtgggctttaattcagcatcacctcatttgatgatttatttactaatttatttccatcacaaatggaatcagaaatgaagcgaaggcaaaaaatctttgccacaaattcatttatatttgcatgagtatcaccaggctacctgcggatgcaatgaagccctatacccgtgcctgaagtcaggagcacaggacactgggagtctgtctcagcgcagtaactgctacatggtacgctccacatggtatcctctccacctgagccctcctcatccctcgccccctctccacacctcaccctctccacactgtattatctcccactgcaagcaacgcagaggacacagaggtgcagctgaagtgaaggcaggccagttcttttccaattcactcttatgaaaatgtgttaaatcccgttaaatgcaccgacctgaactgaaatgatgatatcagtaaatttgttgttgtcatctgatgcccacacagatctcagcacatgttttgggaaaggctgcagtgttcaaggagtactagaaatgttctttctgagtggactggccatgataagccaaagaatattatagccgatagggataaatcatggttttcccactgcgcggttgcctggtggagattattccagcctttatttacagctacaaaaataatcctgcctcaaggattttaggaagcaaccacctcctgcctaaagaactacactgcattgttgacttgccagctagaaaccagacatgagtcgtgcagggaagttccctttgaacggcttgaattgttgtcactagagggtgctaaatgcccctcaaaaaggcctttagagagaatactagtgtgcctaattcttgatttaaattccttgaattgacattattttacaaagtggtctcattttttacttgttaaaattaagatctaacatttataatgcagaaatggtgtttttttttgaaaaatttggattgttcattattatagaacataaagaaatacacgttttaggagcaaacatgaattacacagatctgaatataagattaaaggcataaatctgggggggtgagatttgtccatggaaattgtataattgttttatgccactgttaatgattttaaagcctgaaaaatttaccactttacaataattttagattgttcaatatgttcccaaatgtgagttgcatcaaattcggtaaatgtagagtatgtttgttttctctgtacacaatactgacgtcagtgctagtgcctgcctaaactcagacaccagtagatccttttccagaactaagtgttataggaggaatatggattatactgtaatatatcagatgtgaaaaaagcctcacggtcccttcctttctcaaaaaaaacgtgtagtattttggaatatgcatggagtatagcacttctaaaaatggtactttatgtatatatgaagtaaaataggccttaaaacttaatatacagatttccttgaaaataatcttattatacatttacactgactttttggtcatccaaacattatgcacttaagcaaaaagaaatataaccaattttgcaactttcctcttcctgcctttgcttctacttaaaaatatctgcagtatttccttttctcgccgcttccactttggttcatataccaaggaatcgtgaggtcaatgggtgacagttgtttgtctgtgttcacggctgtcgggcggggctgggtgtgggtaaggctctgaccgacatctgaagaggcttcacccactgcggtttaggatacattttcctctcgctctgccagtagaacagggaggctagttttcaatgtgttctacagaaggataattaaggcagtgtgtcacctgctcgtctgctatttttaaaaggaaacaaacataacctttgcatgtgagaggcattgcaaactagatgggaggaggcccggaccctgtaacagtcgtacattccggtcccagcttcgctggggtgcaactgcagataaaagacgctggctcgacaaaaagcgcccctgggctctgcattgccagcatgcacaatacgaattgctaatgatgagctggcttaggtaggaactgaggaccctgagtgcagggctaacctctgcttcacaggaggggtccactggcgcgcgctggaggcggggagccttcgtgatatttctccgaagggaagagtccatgcagcatcctgataacagggaccttggcttcatccccaactgctcggtgaccccgatgcgtcatttaattcatttgtgccaatattcctttttcaatcaaccagtaactttgcaggtttgttcaaagaagaaattaaaatgcattggagatggaaggcagccatcttcccggagccccagtgctgacactgggaggggaaccccaggattccctcatgactgtgtcagtgatggccctcaacaagcacttactgaatgagtgaatgaatgaatgaatgaatgaatgaagccggccacagagcccaggagtatcaggggagagcaatactggctgtgtcagtggctagtccaggagagcccttcaagagcccagagttcgacttgaacttgggactcccctgggatgggtgaggttctctcaacagcagttgacaggagggaactgggacaggcccagccagtttcattcagtccagccagctgtggctcctctttaggaatgtggccaggcccagctgtggccaaagcaccagccagtccctcagttctgaacagaacgtgcccagcatcagtgccttcatttgtttttaaactgcctgctgaccatccacaaagttaagatgacagctgggacttaagttgtgaggaaccagtggctcccccatcactctctctcacacacacgcacatgcacacacacagagacacacagacacacacacatgcacacacacagagacacacaaacacacatgcacacaaagacagacacatataaacacacatatacacacatgcacacacatatatacacacagacacacaggcaaacacagacacacaatggatggtatcgatatctatgaacagatgagagagagagacagagcaggaggtcatctgctccccacccctcttctccccactgtcaccacctctctcccaagtctagctgcaggccctgtgagctgtggaagtggcttttttaagctgtcttcttagattgagtcattgggcagtgaggaaggtaaattttctctaagaagcctcccaaatctgtatcttatgggatttccgtctcaataattgagctaatagtacctgtaagcaagtggatagtcaataaaaaaaaaataccggctgtaagaacgaatgaatgaatgagtggatgagtggatgagtatacatcctctattttgctggcatcatgattattttacagcagatttatctggatttcaatataaaataagagctcccatttgtatacaacttagtccttgtaattttccaaagtaactctgattaaaattatttccagccaaactatttaggcaactgggttggtttcacacgtacttatcagaaaccattagaatggtatattgattgcatttctagacatttgccataccaccatggcaactgtatttcccaagatggcccagtaggatgtcccatcatgcataaccttctataaagtgacattgactttgcttccatcagaaagtgaggtccacgttcccactccttgaatctgagttgggctgtgactacagcagaagttcagctatgtggcttccaaggctaccttggaaaggtgatagagcttccacctgattttcttgggaacagccactcttaaacctcagccaccatacggggagaaagcccaagccatgtgacgaggccatttgtaggtgttccagtcatcagtcccagcccacagccagcattaacccccagaggtataaatgaagaaaccaagatcactccagccccaaccggcacttgactgcaaacctataagagactccaagcaaataatatctatctcagcccaatcaagccctggaaccatgagagattctaaataataaagtgatcattgtgattttaagccactgagtcctgcagtgagttgttatatagcaaccgggcatcggcataccatcagaagattccttaagaagaaacttttgcaacgttgctacagcagaaaatattccttctgtatgatcattcatccattcatcaatcttgattggcattgcctatgtgctaagcattgtcggtcactggaggtgcagaaaagaagtgaagcagtattcagccaaacaaacaacttgcatattggatagagagaaaaatatgccaaaattacaacagtattttgacccaacagaaaggacataagaagggaacatcaacagttccttcctattcttttccaccctttttctttctaggctcattaaatgtagaggtgcctcagggtcactttgccccatgagagtagataccctcctctcccatccctaactttggtcttcactctatgcctgataccagcagctccccaggctcctccatgctgttggcaccccattcccattctctggaaacatctcagcccatcaacctcagattactttcccaaggagatgtgagaaaacttcaattttcccctttgtgacttgcagagaaataggggtggtaaatgagaagcagagggagagggtggggattcattaccttgagttactaaagagaaaagctctagtgtttagaaggtgctgttattattttctctgaaacattagctcctagaaatcagaggctctgtccctagcatggtctctaaggcttccaggacgccccaggggcttccctcagtcaattttgactctaatgagagccatctggaaggctgcaatggtgggcctggctgatcactggaggggccttcgctgtgggcacagggacgtgcacaggttcacagagtgtgtctccgtttctgggaaccatggtcctgtgtgctccttccccaaagaaagcaggagaaagaaaaaccacagtcctgagtgggattctccccaaacatctaaaaagcttctttaaagaagtcaagttatcataattaaactcacatatggaatgcctatagacaacgtgttgctcttccaatcccagggagctaggacacccaaaactcacctcccagacggagctaggatttgagatactggattccacattacttaaagctgttcgagcttttcatcaggaatggaaagcattaatgcgtctcacacgtcactctctgtttcatggaattcttacactggggagctctttttattttactatttttctttaacagccagaacactgagaagtttgcaaagaaatttttcagctgcctttagtgacccttaactcaagaggttttgcctaatctgtaaattggagttgaaaatatttcagtacttttggagtggggagctttttgtctttaaaagagtggaacgacactaacaatagggctatacataccttgtgcttctttgtcagttactgcaaaccaaaaccagatgtgaagtatcagcggctacctcgtagtgacccatggaagttgaggctaatccatatcattcttaataactcaaaactgccaccttttaaccacctaatttttttctcacttacaaatgcaaaaaaaggaattgacagtacacattgaaatcgattttcccctgaccacttacagattttctcctataagagccaggaataaaagctcactccattatatcaagcagccatcatctgagtatgctttagtttaggtgatcatcacctttaacaaaccaagatctggaaggaagatttctgatctttaacaaaccaagatttgaaaactagatattcctgtcatgaccttttcccaacattcagtatgtaagggattcactggattattagactgcttgtaaatgtaagaaaacatagaaggtttagtgtgaaggagttagcaacctaacaaatgtttccccctgaattttcaataaccttcctgaatttaaaggtaatgaatataaatgaagaacaaaatcaatagatataggaatgattcacaacctcccaaatgaataaatcaatcattccaccctacatttgaacattcaatcaatattttgtctatttactaaatctaagaggaactactttaacataaaactaaatatgaaattatttccagcattgaatattgtgttttgccttagagcaggcacaaagtggaatgcctatgggtacaaagctaggcattgattgatgtttaatacctacaaatacagcaattacactgtcatgctacacgagacttcctattcctacactgaaattagactgcacatatgtagggataaaagataagacacaatcatatcatatttcctcaaatctaagactttgggtggtaagatgtaaagcacatcatgatttaaagtatcactaggaaagaaaaaacaattctgccaatgaaaattcaccgtaatactttctaatcaatcaattttaagatacatcccaatttttaagcaagaataaatgtgttaaaattaacacaaattggtacacttgtgatacaacagaagcactaaaatgtcacagcaatagaccacagggtttctcaaccttggcagcatcaacattttgggttggttaattatctgttgtgggggctgccctgtgcatggcaggatgtttgctagcattcctggcctctacccactagatgccagtaacacctcgcagactccaattatgacaaccaaaactgtctttagacatggccaactgtccctaaaggtgcaaccaaaaactgtcccagttgagaaccactggaacagagcaattcggttttatcagccttgtaatataattgtgtgtgtgcactgtgtgcatgacagactgtcagcctaatggaaggtatattgtcagatgggatagattgacctgaaaaaatcacataaaccaacagctggtacatatacaagagtgtgtcctgcccatcctaacccacacaatgcaaaagaacctggatgaccacgagtcaccatcacaggagtttactatccataagtgtaaaccatccaagaaaagtgaaaacagattaaagaaaataaaaataaataaaccaccacacaatatttgggcctagccagataacaacaatgaaaaaatgtaatattttgaagtattggcaagaatgtggaggaaaaagcattgacattcgtgtataatgggaataaaataatttatcctttgtctccgcaattgatattctagaaatctattttttagaaatactcacaatagacagttataagtacaaaggatgtctgctattacactgctcagtaacagtaaaatatgaaaatacactgtacgtctttcaatcagatattgaataattatactacacagtattaagaatgagatagatattaatgtactgcatagaaaatattcaaagtataataagttttagaaaattatcacatatgtatattagcatatgcagagaaaacatcttaaaatacaaatttcagttttgaggtttggatcatggagtaactgcccccttttcaagtcaaacagttgagaaaatttaggataaaacaagtgtgtgctacctttgtaatcagataaagtattttaaaataattcacattataatatagaaatactgaaatgccaagaaaatttaaatatattaattaaaacctacgggccaggcgcagtggctcacgcctgtaatcccagcactttgggaggccgaggcaggcggatcatgaggtcaggagattgagaccaccctgggcaacatggtgaaaccctgtctctactaaaaatacaaaaattagctgggcatggtggcgtgtgcctgtaatcccagctactcaggaggctgaggcaggagaatcgcttgaaccagggagtcggagggtgccgtgagccaagatcatgccactgcactcgagcctgacaacagagtaagactccgtctcaaaaaaaaaaataataataataggctaccaattagactttatagaatacataaatatattaatatagctacaaagaggttgaagcttattcattgagacaagagtatttattgagcatcgactttattaaatacactgttagtaagataacaagtgaaacttgttaaaaaaaaagaaactaggacaaaagaaatttgagttgagttccccaaaaacagggaatattcagattgtaggggaaattgggtaaaggatttgtttcagcatgaaaggagcaaggagcaaagaaactaaatgggaggttatgctgagaagtatatcagtatgaggaaatatcttgacatctacagacaaatatttgttgccaattcattttgggcattgaggattcacaagaataattaaaaacacgtaatataaaatccttctgattagagcacattttatggcactgcataaagagatggctgtgggagtcatttatattttaatactaacttgaacaaggcttggttctgcaaataaaacagaagagtaaatatgaagtggagcacataataatgttactgtttctgtgggtgagcttccataggaaagaggcaaaggcatcaatctcaaaaagttagaaaaacccaaagaaagaagaagaaaaataacaaatgagaacaaaattgagaaaattgtaaataatatggtagagaagataaacaaaaccaaatctggttctctgaaaagattagttatgtgtaagtcactggtgattacagagagaaaagagggaaggttaaaataaccaaagtcaacaataaaaagggggctattactacagatgctgtagacattggaaggataatagaatattatgatcaatttcctatcaataaatgtgaaaaattagttgaaatacataattggaaaatataatttaccaaaactgtcaaaagaaaaaacacaaaacctgaactcctataattattaaagacattgattgaaaaatctcagacctcttaaaggacaactccaaaaataaaaaaataaaaaaaagaaagaaagttccaggccagacggatttatcagcaaattctaacatgcatttaaaaaaaaaaggatgccactcttacataagcttttcagataaaagaaaagaaagcttgataccaaaatgtagctagaaaattatttaaaaaggaaaattatgggtcaatttcatacataaacatagatgcaaaatcctaaataaaattctagaaaacaaaacccaacagtatatacgacaataatatatattgtgaacaaactggatttattttaagaatgaaagcttgtttcaatcaaataatcaaatttacattgtaaagaaaatttatataactttaaacaaaagaagaaaagcacttaataacattcaacattcatattaaaaattcttagtaaattagaaataaagaggaagtttataaatcctacaaattgataaaaggaatctaccgaaacctacagtaaaccacacattttcatgtcaaaactttaaaatttaatcatttgaagttgggggaaaagacaaagaagccccacatattaccgcatttgtctgaaattgaattggcagtcttagttagtaaagaaggcaaggaaatgaaatgcaatgttaaaggattgggaaaaagtaaataaaactttatttacagatgacatcatttttttacacagaatttccaagagaatttggaaataagtcattagaattaataaatgagttttaaaagtttgctagatacaaggtcaatatagaattttagttttatatatcagcataaacatcaatagaaatcaaaatttttaagtgatactgttttcattagcattaaaaataccttacaatatggacataaatctaacataatacgtgcagaacctctacaccaaaaactacaaaatattattaaaagaagaccaaaataaatggatagatatattcatggattgaaaaacttaataatcaaaggtagaattttcttcaaattgatcaatagattcaatgcagatgcattcaatatttcaacaaagtttttgtgaaacttgagtgattctaaaatatgtatggaaatgcagagtcaaaaacagacaagatgctcttaaagaagagtgagaaatacaaaagattatcagagactattacaaactggaaaacctagaggaaatggatacatttctgaacacatacaacctgccaagattgaatcagaaagaaactgaaaacttaaacagaccaataacaagtaataagattggataggaaaaaaaatctcccaacaaagaaaagtcaaggaccagatggtttcactactaattctaccaaacttagaaagaagaactaataccaatcctcaccaagccatttcaaaaaattaaagaggagagaattcttcctaattcattctatgaggccaacattaccctcataacaaaatcagacaagaacacaacaaaaaagaaaactacaggctgatattcctgatgaacatcacttcagttcagcatggatacaggccaatatttctggtgaatataagttttctagtattttgttcagcaaaagctatcaacaaaatattagtagcctgaaaccaacagcacatcaaaaagataatgcaccatggtcaagtgggatgtatcccagagatgcaaggatggttcaacatacacaaatcaataaatatgatacatcacatcaatagaaaaaaacaaaaaccatatgatcatatcaataaatgcagaaaaggcatctgataaaacttaacattgtttcatagtaaaagctctcaacaaactaggtacagaagaaacatacctcaatatattaaagtccatacatgattaacccacagctaacattatactgaacggggaaaggcggaaagtctctcctctaagaactggaacaagacaaggattctcatttttatcacttctattcaatataggactggaagtcttagccagagcaatcaggcaagagaaagcaataaaggtcatccaaactggaaaagaagtcaaattgtccctctttggagatgacatgatcttacatctagaaaaacctacagactccaccaaaaaactcttaggtttaattaaaaaattcagtaaagttgcaggatacaaaaaaatcagtagcatttatatacccaataatgcactggctgagaaagaaatcaagaagaaaatcccatttacaataggtataaggaaaaaatatctaggaaaaaaattaaccaaggaagcgaaaaatctctacaaaaaaactacaaaacactaatgaaagaaatggaaaaggacacaaacaaatgaaaagacactgcatggtcatggatcagaagaactaatatcattaaaatgaccacaccacccaaataaatctacagattcaatgcaatccctgttaaaatattaacgtcatttttcacaagaatagaaaaaaacaatcctaaaatttatatgaaagcaaaaaggagcctgaatagctaaaggaaccctgaacaaaaacaacaaaactgggagcatcacataacctgacttcaaaatatattacaaggctctagtaaccaaaagagcatgatactagtataaaaacagacgcatagaccaatggaacagaattgataacccagaaataaatccacatattcacagccaaccgactttcaacaaaggcatcagtaacatacattgggaaaaagacaccctcttcaataaatggtgctggaataattggatatccatatgcgaaagaataaaactggacctctatctcttgccatatataaaaatcaactcaaggtagatgaaagacttaaacttaagaccccaaattataaaactattaaaagaaaatagagaaaacatttcaggacattgatctaagcaaagatttgatggctaagacctcaaaagcacaggcaagagaaaacagacaaatgagactatattaaactaaaacacttctgcacagcaaaggaaagaaaacaaccagcagagtgaagagacaacctgttgaatgggataaaatatttgtaaactgttcatctagtaagagaaaatccagaatatacacaaaactcaaacaactcaacaattaaaaagaaaacttttacaaagtgggcaaagaacgtcaatagacatttctcaaaagaagacacaggaatggccatcaagcatatgaaaaaaaatactcaatatcactaatcatcagggaaatgcaaatcaaaaccacaatgagatatcatcataccttagttagaatggcaattattaaaaagacaaaaaataacagatgctggccagaatgcagagaaaagggaactcttctacactgtgagtgggaatgtaaattagtacagccactatagaaaacagtagagatttctcaaaaaactaaaaataagactcaatataatccagatatctcactactgggtatttatctaatgaaaaagaaatcagtatatcaaaaagatacttgcacccacatgtttaccgcagcactatttaccatagcaaagacatgaaatcaacctaaatgtccatccacagatgaaatggtaaacaaaatgtggtacatatacacaatggaatactatttggccataaaaataaggaaatcatgtcacttgcagcaacatggatggaaccggaggtcattatgtcaagtaaaataagccaagcacaaaggacaaataccacatgttctcactcctatgtgggagctaaaaatgttaatgtcatggagatagagagtggaatgatggttaccagaggctgagcagagagtgggagtggagaggaagagagtttggataatgggtacaaacatacagttagatagaaggaataagttctgatgttgtatagcagagtagctgactatacttaacaaaaatgtattgtatagttcaaatcagctagaaaagaggacttgcaatgttcctgacacatagaaatgagaaatacccaaggtgacagacaccccaaaaccctgacttgatcattacacattctatgcatgtaacaaactatcacatgtaccccataactatgtgtgtgtgtgtatctatctatctatctatctatctatctatctatctatctatctatctatctatttatagtatccatttttaaaaggcaaatcttaaaaaaaagagtgaggtaggacaacctgctctactaaacatttttataaaggcacagcaattaggtcagaatagtgttcatgcaggtagaaacaaatcagacaatggaaaagaaaggaaagttcagaaacagattcacacatatatggacacacttgatttttgacgaaggtggcagttgatttttttttacaaaggggcagagtagttaaaaaagggagaaactgttggtaaatgatgctggaaaatgagaaatccacatgagaaacagaaacttgagaagtaactcataacatcacaaaaattgatgtcagataaactataaatctaaatatgacaagcaaaaactatgaagtttctggaacataatatagaaaactatattcctgacttgggaagggaaagattttaaaaacaaggcacagaaacactaagagtaaaggaaagactaataaattgaactgcattaaaataagaaaaaaattaggaacttaaattttcatcaaaagacactattaagagaatcaaaaggcaatgcatggagtggaagatgatatctttaacacatctaatctactattcatatccagaatatgtaaagaacccccatcaatcaataagaatacacacaagtcagaatacacacaaggaaaaacagggaagaaactgcacaggcagtcataaaagaggatatccaactgctcattaaaaggtcttctacttcattagtaaagcaggaagtacaaattaaaacctgaatgaaataacaccacagatacatcagaatgtctaaaacaaagactaacaatgttggtgaagatgtggagcaataagaactctcacacacagctggagtttaaaaaacatccttatttatccatcagggctgtaataagaggcatatagcatattcaaataggtaagtgaacaaaatttaatgaaagaatttacaacggtaaaggtagaatttagtaaaaaccaaagggtgaggaagtcccccaggctagcaagaacaggaagccattactaccctcaggcctacaagggcaagggaggtagcagtcacgcagcaccggtagctgtgaacacaggagaggataaacaataggagctgtggccttccatggagggaaaaagtcactgccaacccatgaccaaagagagaaagctggagaaaaaaactccccaagctctctcctcctactctcaggcttccttgtggtgactctcatttgcttaacccaacagaagatagaggacaaaggagcccatttgatgtagtcgacagaagtcaaactcccaggacaagaggagcagagaaggatggagaatgaattagagaagtaaacaaagaaagtcggcacatctactgtcatcaaagactgtgtaattccactatttaatacatgtacaatagagatgtgtgtatatgtgcaccagaagtcacctacaagaatgtccactgcagtattattctctcagttaaatgctatatctggctgcacaactagattaggactgagaccctaaccacacatgtagaagcagggagaaagatgcagttgagaagccctttgccatctgatatgcttccaaacaagggaaactcagcttggacactgaaagcattttgtataaaatactgtttgtatgatatccccatgtcaccacacacacacacatacagacacacacacatacacacacacacaacaaaaacaaaaaaaacttccagggttacttttctcctcagttagcaggtcaaaacttttcacgtgtgaaatacttttgcaaggaggcagatgaaacgggggagaagggataaccttgccttgcagtcatctatcaattcactgcaaggaaggaacacagagcttagatatgaagcatcaggagttcttcccaagacccttcttgtcccttgggaagagccaggagctggaggggatggccttcactgagaagtggcatcaaattagaacctgcacaacaaataggaaccagctacttaaagatccagagaagtagccctctagactgaaggatcagctcctcaaatatcctttttgattttgaactcacaagttcaggggcatccgaggaacagacacaagccagggctgaacaatctcatctgtgtccatgaggtgggcaagagccagatcctactgaggagtttgaacttaatcccaaacatggcgggaagccattggggccaaagatgaattagggattgtctgatctccttgacacgttctgaaggttttgtgtacagaaaaggtttgtcaacatgcacaaaggaaagctgggataaccaagctaagacgctaccgcatcattctaggggacgggtgactcattccaggagtttctgcaggaagacctatcaggactggtgattgactggaggcagagagcacgaaaaaagaacaatcagagatgatctgtggtttgtggttgttgtgtaatgttaaggcttaacaactgcgaaaatagtgtttttactttacagagaagaagacttgaagaatacaagattggggagagcagatcgggatttgtactttatatcagacgtgctcatagatatacatgttgagatatcagttgggagctggatatatcaggattcgagactgggaatcaccagtttatagatggtttttaagccatgtgattggatctcatttcttagtggggagaagtgagataacaaataaaagccaagattaaagctgaaccttcagcctgcccatcacttagaagcccagcagggacagaagagccagccgacagcacagagtcgaggaggaggatttccgggcttcagtgagtgtgcatcagagattcatggacacaacttaaagtaagaccagccacacagttcccttcattttctcaagcaacattcagcatctcaaagtgcggctactacacacggagccaagccctggtccagttatcacaaaaccttactagatatgtcgattattagctgcattttatagctaaaggtaggcaggcacagagaagttacgtctcttgcccacagtcacagcaagcaaacagacctcagaccaaagtctttctaactccttatttcacatctaaaacactatgtgacgccacctccaaaaaatgtgggggttactctaggacaaaagaagctcatgaaagcaaagagagaagcatagagcttaaatttagaacaatattcagggtgattgggaaaaatagcctccatacaaatataatcggttcatcaccaggtgaataaaatgagagaggaacctggtacaagtgaagttcattgaatttgcttgcaaaaaaacataattcaagtgtggaagtttggaaactaaaatagtaatcagctaaagaaattttcaggccaacttagacacaatggtgacaaagctcccctgaggagacaggaactatactacttgcaactctaactgaatggacttaacttagcaattaagatcaccgtaagtttgatcagataagtattaaagggtgtcttgggtacatttgcagattcagacactcttagttgtgaaattcttcaccaaaaatttgcaacttatggcttgcacattaaaaacatgatatgaatgaaattcagatatctcttggtaaattttataattattcctcccatcagctaaagttctcagtatgaagggttataactgatgtcatatacaataactacaagctgtatcatacaaaaattgagaattttctattatagaaagagttgctttaatctaaacctaaagtagcatcaataatttttcgtaagtggtccccttcctatgagtaagcccccaggaaaaataaattgcttttaagaaatgctgtaagtaagctgtttcatatataagttttgacaagatctggctacttaaattacaagatataaaatgagatttgtactttttctcaaatgtaaaaaaaaagatttacttctgaaataatggtctttataaaatatgcatttttgttcctttttcttatcatatctataaatttactaataaaagattctatcttgatttactaacatttgaaaagattgattatattggtattgcaagaagaggataccataaattaaaaatccatatattaaccatattcttttatttgcaatatgacaaatgattgtgtaaagttataatcaataaaagctatttgaaagtcataaaatggatattgccataactgctttcctagcaaggttaaaacactttaactatttttaatcaacttacagtgtagtagatcaagcatatctaaatattttattttaatcaagcaaatatatttctgctgttcctatgacagtatgaaagtttggttcaaaatatttccaaggtatttaacacagttcagtagaggtcctgtctcataaatcaatttcagattagataaaaggaaaaagcaaattcttgtttacttcagaatttttcaagccagttccaaagacagagttgttactctcatgtgaattttcagtagaaagctgaacaacgacgttgctctgacaatctttttaaataccatatgatggagacagaataacaaaaacaaagtaggtataagctgtacgaaattatttctcttggacataaaatatgtttggggaagaaatgcattgttccatatggactagggtagttacttctcaaagtgggagcaactcagactctgaaaaatggtttctcaaaggaggcattgtgtctgggtgaggccagttttctagtcaaaatcattttattaaatgccattggattgaatgcttccaggtttgctctctgaaatatgccctatcattcttaaaaaacacacttaggtagcaaaaagggcacactaaaaataacgtgggttaatgtttctatcctgcctgtgttttctaagtagcccctgcctgagctttcgacttttttaaatgaaccatcaaatagttggttgtctatcacaaataagccatctattttgttattcctgtaactttttgtagaatccagaaagtaacattcttgctgatatatcttatataacaccaagtccattttccaaatgaggattccaatgagtattcatcaccaacatctccccgaaaaatatttagaaaaaacagactcaatcctttatccaaagtcagtgagtaagaggcgggggccagggttggacaaaaatctctttggccaggaagccggtggtcaccctgatctacttctctaagctcccacccctgatgaatgttcaatatctgagtttcaccccactcattattgtaattctccgtaaaaccccagttacccacacggaattctcatctacatctagcccaatttgctactggatttcaatgttatttcatatgaaaacaatcactaacagaaagaacctggatctggtttcgaaaacataatttgaaaggaattcattctgaaggctgcaaaagcccagtgatggcccatcggtaccctgaatgggcttctcaggtgcctccactctcctccgtatgtctccatccatctcagaatacatgtctggctcttcctgctcataaacagaaacagagagttccgggatccaaaggcaagactgcgatttaagagacactttgtttttgtaggtgttcaaggatttggaatcaaagcagcagaattattaaaattaatccaattttcttgcatttattttgttagttcatacctctaaaagatatattttggaaggcacccttcaacccacccatttacaaatcaaagctttctttggaatccctgagaccaaacccaagctagacagtgacacactgccagctccagagccctgcccacctggaaggggtatggaatgcactatttgacttgagctcacatttaattacagtgtcaaaaatcaaacttaaattgctttaatcagctgccaacactatgagcctttctggcttgaatttctataaacaaagaataaattcaaatctgtcacaaagtggcagcaacttgttgaccactggactaggaatcgttatgcaaccatggctcactgtggaaaaagtcaacatcttcctatatgtgactcttttctgatcttttcggactattagtcaacagaatcatcataaagctaaattatctatctgcactgaaattactcagcctcagacatccaaaccagtagctgttcaccaatgaaacctgaataaagctgttgctgactttccctgcttcaatttagagtatttttggaaacatcattgcatgtttaaaatataataagcaaaaggacctttggtaattaaacattctgtaatttaaaactccaagagacaggagcagtgataagatattagattttctttactggggtgaaaaagacagaaagtggttaactgtttaaaaaaagaaagaaagaaagaaatccaaggatttttagagccagaaacagtaacagtgtcctttattctggaaatgtttaaaagcctgtaagcagagatcacccagttcatcctgagcattggtgagcaaataacttctgaaatgctcttgaaagagaattctccagccttctctgtttgaaatacttcctaaagcaaacacaaaagtgggcaaaacacaagagctcatgttaattccaaacaaagagaccaacagtcgcaaattgagagtccatcttagaagcgggtgctgcttccacatcaagcaactattggaaagagtaggggtagatgcagaattaagatcatttgtgactacagaaagagacaagaaaattaatttttaaaactaaaagagaaatttatttcagataatccaaggaaatgagcagagtcaacctaacaggattctcaagcccctccctactggtgtggtgtgaagatcacacgtggtgtagctgacacccctcacatcttccccgcgcccctcctgccacctctttttggcattcaccctctctcgggttctgtatccctgcccatgttctccatgaaaggccatgttaatgcccatgctctttcctgcctctaacagacgatgccttccacagtcactcaagctttaaccctcttctggattcggacctgtacatccaaaagcctgccagacatctcttccagatgctctcagagcacatgaccagaagcacgcgcaaagctctcctgagcctcagtgctttccctccaacacttcttccactctctcagttaccgagccaagacacagagttgcttgtgagtcatttctctacctcatcccccacccaaccttcctgcgagatcctgctcacgttacctcctaaatgctgttacgtgacttcaaccacgtcagctttttatgggggaggagaggcacctgcatatctgtgggagcaccaacctctagacatctcctgccaagttactgcaatgtgcagaaaagaggaagaaagcaagcccaagtcgcaaagtctttgccagtccttctaccaaccacaccttcggtggagatgtgggtctgtggaaatgcagagacggactgaaagccaaatgggccaatgagagctctgaacaaaacattaagcttgtttttctttaaggcaatacgattaacagtggtccattaagaatccgtttaaaaaaaataataataatactttttctgactattgttggggaagaataactcctttatggggagtatgaactcaaagacatgatattgtaaaggaggccttgaagaagagagggactaagaaatgtgatggcgtggtctgttacatgtgcaggtgctgtgtgtgagggaagcactgaggaccactggaggatgagggatgctctgtccttctcgggtatggctgaaggacagggattgcccatcaaggagtaaataatccatgagtggactaaattctttagaaacaggaactcaaatccagtagggattaggataaaaatgtaaactctaatttgcacctctccctctctcccctaagtagtccgtttctataattttatactaaatcaattaaatgtatctgctataatattaatcataattttgtctgaagtagtaacaactggaaactacctaaaagagtcagagcaggactgtaagactatattgtagtctacactatgtcacagcggactgcatcatgatagagaacgatactcatgatttaactgataaacacatatggcaatgaataaaactgtgagtaagatgtctttaattttagcaaaattatcttcattctaattttcaagtaaacttaaagatttatatataaatgcacataatttaattaaaatacatgcatatattaactagaaggctaatcccccaaaatgtccatagatgttatttctgagtgaggagggtcaggaaggttttaattttctttgtactaactctatttactaaaatgtccacctggattaacgttataataaaaatgttaccgtttaaaataaaatgaataaaatacaccggtatgaaggtattattagaacatacgaaagtacaaaatcaagcagcaaaaggaggaaattatattaagaactgaaaaaactatgttgagaattctgtctaagaaacgctgtagcaattaagaaaaatcccagttctgcaagtaatgggagaaagatgatgacttccagaactttcaccatctactaagatgttcaccaattcctaagaagggactgaatacgtctgcatcctcagatctgagagtaattttccacgacgcatactgagcaccataatgagtgaagtctctgagatgacctctctgacctctctaaaacaatcaggcactgcaaacatggcctatcccacactagcccttggtgaaattcaagggcataatattagactgaaacagtgagaagaagattcgacatggagtgcggcaagaatgtgttctagtccttgaaggccagcgctattccaagtgtggtctcagaccagcagcctcagctgcagctgggggcttggaaatggaaacgtatgtgctacgtcctggacctgtggaatcagaatctctgaggtggaccaggaatctgtgtttttaaaaccctgtggttggtaacttcctgctggctgaggacagagagaatgcttagtgaacgctgaggaatgacgggttaaataatccctgaatgattcctgagcggatcaatttctcagccagagttttgaccgcagctgatgatgaacagggctgtgaccaccaggaagggtctgaagaggaggcgttgattgcagttttctgcctctgatcctcaggcatggagccccaccccccaactctcttacacggaggccaaagaaaaagctggaattctccaggagagcaggacctgttaaacagcaaagggcaacccaaaattgtatgagtggccttgccctgagaagctttgaagccagaggttactgaacaactaccctggttaaaaccctaacgtgacaatgataacatgtgactgtatgtggctgtcttcaaaacagcaatgatttaggcacaactgtggatctcagattgttccgtgagtttggtctgataagattgtatgcgtttcccaggggtgccataacaaagtgccacaccctgggcggcttccgccaccgaaatgtattttctcacagctctgaggtcgaaagtccaagatcaaggtgtcagcagggctggttccttttgaggctgtgagggaggatctgttctaggctctctctcccccagcttctgggggctgctgcagtctttggtgttccttggcttatagaagcatcatcccaatctctgcttttgcgttcacatggccttctcctcatatacctgtctgtctccaaatttcctcttctcataaggacaccaagcactggattaggggcccaccctactacatctgcaataaccctatttccaaataaggtcacattttgagggaccagctaaatacaaaacattagccaggcatggtggtgggcacctgtagttccagctactcaggagaatcacttgaacctggattagaacttcacaattactgacacgattcaacccatattaggttgtttagtattatacattaggaagccatagcaaacttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcacccgccactacgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcccatagcaaacttttgtaaacataactatttattaaaatttggtataattaatatttaaatatcctttctggcaagatttagccagttttttaagcttcattgagagaaccacaatattagcattaataatagaatggtctattaattttttaaaaagatactatgtctgcatttccaatataaaattcacagcaatgattcaggtagaaattaaatgaggatgtcattgtcaaccttttaaattatattacaggagcagggagcacacgggccctgaggtagaaatgaataaggaatattctagaaccaccaagaagccagtgtggccacagcagagtgagccagtggtgctggaggcaggtgagatcttgaagggccttggcaacatgaacaggagcttggattttatccacattgccgagggaagtatgaggtggtgtttagcagggcataaatctcatctgatctgtactttgaggaaaacactctgacttctgtgtggagaacagtctataggaagccaagaggagaggcagggagatgagggaggggtgacttcagtctccaggagaatgagctagtgatgtgaattaaggtgctggtggtggaggaagtgaggtggagaactggacactgggatctattttgaagagggagcctacagaacttgttggtggatggctatgagggaaagaggattaaagaatgatgctaggcatttgggcttaaacaaacccctgagtaaatggttatcctattattaatactaagatgggtaatgctagggaaggagtagccttggggagcagtgatgagttattttcttagagagaagccacgttacctataggaggctcaacagagtatcaaattagaataaaatatctaatgttctgatttgtgtctttattttttccattaagatacacatggctggccaggcgcggtggctcatgcctgtaatcccagcactttgggaggctgaggcaggccgatcacctgaggtcaggagtttgagaccagcctggccaacgtggtgttaccccgtctgtattaaaaatacaaaatattagccaggcatggtggtgggcacctgtagttccagctactcaggaggctgaggtaggagaatcacttgaacccaggaggcagaagttgcagtgaaccgagatcacgccattgcactccagcctgggtgacaagagcgaaactccgtctcaaaaataaaaataaacaaaaaccatgggaaagaacaattgaggaaactggggacttgtcctggaacagaagacacgaggacttttggttttttagttttgtttttgtttttgagacagagtcttgctctgttgcctgagctggagtgcaatggtgcgaactcagctcactgcaacctccgcctcctgtattcaagtgattctcccacctttgcctcctgagtagctgagactataggcgcacaccaccatgcccagctaatttttgcatttttagtagagagagggtttcatcgtgttggccaggctgtcctcaaactcctgacctcaagtgatccacccgcctcggcctcccaaagtgccgggattgcagaagtgagccactgcgtccagcaagaatgaggtttgaagggaggcatgattgtgttctcttcaaatagttgaaaggttccatttgaaaaagggatttacttattcctatggttctagtaagttgcagagggtggatctaagaccattgggtgaactttacagagaggccagaaagccttctccaggggaagaaagtcaagaaaaggtctcaaaactgtctggcagaattctgcacaggagagtcctcaattcggtgtagaattggcaagtataataactgtaaatccctctcaatctaccatctacatcattaggcgacatcttcatttcctgaaaattccaacacatgaaggctcacttactatcaagatgagcaagtttgtgctacatagtgaatttgatttcaataggactcattttataccttttaagagtctttaaaacgttgaaaatgtaaagatctgcaagagcaactgatcttcaaagtcccgtcgagtcacaggattttgtaatgatgtctaaagaggaaaattcccatttcagaaaaggctcaatagtatttaatagttagctcaaaaggacgaataaagttctacatgggaagctgctgaactacagtcaggccaaaccttcatactcggagaagatgactgggcctgtagacacagatattgatgataaatcatcacaaaccacagctttccttaattggggtggtgggcagggagagcaggcttcaggttggccttcctccagcaagggcacacacacaaaggggacctgaacacgtggagcttatggtcaggaagcctgaagtgcctgacccagcacatctggtgactagtagtgtagattccccacagaaggaatgacaaggcgtcattattcaaagtgaccttccctccattggaataatcagaaacagctcacaaataaagtaatctgtaagatgcttcatcttctctaggtaacctctccccaacatgatgacatcacttcacatgaggcgacatggttttgtgaggacttttctttccttccaagtttggaatctggctgaaggctaaaatcaccatttacagtgtttgagccctccttcacactttgaagaagggtctgtgtaaatagccattcctacttctcagactcgccagaggcaaaacctgttttgctttggtagtacacgctcttccttaactggtaaaagactttaaaaaaaaataagatgccatttttaattgtttcataaatctggcttagatatattaaggaaattgctattttatatgtagaacagcggcaagcaaatctcaagagattaaaaatcatgttcttgtggttttcttttagaagctgcaaatttgaattcaatttaaaaaatcatggcacagggacaaaataagaatgaacaaagatgggaaaaatgtccgcagcattctgcagagtcaagcgctgctgtgagtgagtgtgcatgtttccaattacacatcagggcttggcgagctccaggagtcaaattcagacagaacccaagtgcagtgcgttacacagaacccaggccaggaaaagcttcacagagtctttctttcaactgaggcaattgtgtagacaatttggttcatttcaagaaaaaaataaaactgacagaagaaagaaaaatattattatattttgcctctcaaaacaaagtcaaattgtgttggtgtataaatcaagattcagtatttccttggctgcttccagaataatagtagatcacaaagagaataagaacaagaaagttcagttctcagccagacgatccaaggtaacaaagggtgagaccctcattccgttactcacaggagcaaacagacaaccaataataattgggcacatgggggtttcaacaagataaactgttatgtgagtccagggtgctaatttctggattcttttgagttgcaaggaaaatatataccgattccccacccccacccacccacataacaagacacaatagttaacagctggaagactgtggttagggggaaatgtgattgtaggcttccatttcaaatgatggaaaatcatttctgaagtcactacgaaagttacttcacaaaactaaaagaagccttgacaccttgtgttatcccatcatctaaagcaattctagtttggaaacacttgattcttggcaggggattctaaagaaggtgccgtatgtgaaaggctggtgtgtcagaaggagctttaaggaactggaatgagaacagccaaaagctaagatttctgattataatcacaggtctggatgtgttcaaggtaaaaagagatcatccccatcatttgcaatattttcaagagaatggggctttagtgacactgatcaaagtctgacatggattttcagctgccttccaactccacatacctgcaattcaatgatctctatggatagtagaagtaactgccaccctgatgttctcatcggtgatttatacgtgaagtggactcaaaagaaatacaacgaaatcccttaataaaaattatgtccattgacccaacaagcttcccagtgctgtatcagttctcaaccgattttagagacatttggtcaaaaatgatctacttgtaataagccatctgagggcactagctctttttcacctctgtgttccttgaagcaggaagtcagtaaaatcactattgaattaaaatgaagtaaagcactttgagatttcagatttctaaattaaggaacacacaacatacggtactttatttgcacaagaattattagaacccagggctaacacccaaatgaggtcacaggtaaatgaaaatctgtctcagttatttgaactcaggtcaacacacagacagagcaaagcaccagctgacctctgatgcacaacccagtgttcttaccatagaattccagaaggcatctcagtcattctcttatgtaaatacaaagacgacaactggtttaaaaattcatttatttttattttagcttctttgtgtcaaactcaaagaagcctcacataaatgatcaaagactttttggtggatcttccaaacgtacatgccgggaaggcctgcttgcactttttccttcaatcctctaaaatgaaggttttgaagatgcttgccaatggaacgttgtgccttacagctataatattttttaaaaggcattcagtttaaattaatatatttggccagacaactgtattaaaattcttgttgttttttctgttataatggtagcctgtggtatgactagtcttcttcaaaaatatgtacagttattgcttctctcttgcctggggtatatcatgtgtttttcatttgagtgtacattgcaatacctcattaaaaccaacacttaggctacacaaaagtcttcatatcatgccgcaaagggcgtaaactaacgtggaaagtttcagagcctcataactcattgcatatacctcttatactagctgctcaactgatatttagctctcctggatgatgtcacagtttttatcctcttaaaatagcctgccttcagaaaatatatagtttccttcatgcactaatcatggggagttacgatgtaaatagagccattttttttcttatacaaggaacaagtgctctcaccctcctcccttctctccctccccatacacagaagcacacttcacttcacttatactaaacacttcacttatacttacactgcaacaaagagttgcaaatacatgcaaataaagcctttataactcccctctctcctgctggacagctccttgactcaagtatttccgaagacagacactctgataagggtctgctctgagcttcattctcagcatacagtcctgggattatttacctaccaatattcacctctgcatgaaccagtaagtcattactgacaagaaaaaaacaatttgtgattttttttaatgtcacaatttttctttttaaggtttgggagagaaagttgttttgaatgtttcatcagtttctattgccaaatgaacacctgtttcagagtccctgaaagtcacacatcagaagcttctgacttcaacatatagtctgctttgaagaattattttaaaaaagcattgactgcttgaagataagcaagtgacactcaatagcttcattctttagtcttagaaaataatttttacacttcacacctattaggatggctactatgaaatataaaaaaaattaaaaataacaatggtggcaaaaatatgaagaaattagaacccttgtgcactgctggtgggaatatcaaatgatacagcctctatggaaaacagtatggtggctcctcaaaaaattaaaaatagaattaccatatgatccagcaattctacttctgggtatatattcaaaaaaatttaaagcaggatctcaaagagttctttgtacagccatgttcatggcagcattactcacaatagccaaaaggtcaaagcaacccaatcgtccatccacagatgaatgaataaacaaaatgtggcatacaataaaatgtcattcagtctttaaaaagaagaaaatttggacacattgtacaatatagatgaatctttttttaaattaaagtggtttttttaatcgttttattttaaagttccgagggacatgtgcaggatgtgcaggtgtgttacataggtaaacgtgtgccatggtggtttgctgcacctatcaacccatcacctaggtattaagcccagtatgtattagctattttccctaaggctctcccacccccaccatcccccaacatacaccatagatgaatcttaaggacattatgctgcgtgaaataaaccagtcacaaaaagacaaacagtgtatgattctacttatgtgaggtacctagagtagtccaagttcagaaagtagtaataatggttgccaaaaggtgggagcatgcagaacacggggagtgttgattgacatcaagtttctgttttgcaaggtaaagaagttccagagatttgctgcaccaacaatgtgaatatacttaacactactgaactgtaaagtggttgtgactacagattttatgttttatgtgtttgccacaaccaaaaataaagattaaattaaaaaataaaagattttatagcacctatcacttaccaaacccactgtacatcttacactcgtgaatattttatgattttcaaaacacctttatttttttcccttatttgttcattccttcatgtataacccacaatgtgttaggttatgtgctgggcagcctggaagacccaaagacgaattagggaagtaccctatatttaaagccttgcaaggacataaatatcagtaatataaagtaaaatatgttcactgctgaaaactgctatacttcctagatttttcaattcaattgcaatttctaatattttgccatgttgatcccacaaattcacttgtgtttaaaagttaacgtgcttgattatcatacagctgcttctttcataagaggaatacagataaaacgctatgggatttcagggggagaaagaacttcttattaaattcatattttcaaccaataagaaaacacaattttttttaatcaacactatcttcttggtgcttttttcacatctcatcctctttcctcctttaccctgcctaagcaaccatttctggacccaatcttgggttattacatctgacggcaagtgttatgtgggccatggaccatgagcaattagccccctctctactcctagggatggagtacatgtgatgatttccatcagactcagattaaatatcttgctggtaagttacccctaaaaatcgattaatggactctccaggtagacactgaggtaatctccaaccaaacctgacttatacttaggggctttggaagcccaccagagtcatcaagccatatctccacctaggctctatactggaaagctggtcagtagtaacacaaagaacaagccatttgggaaaacagcccacatgaaaagaactgtggtttcaagaagagtcattccatcccaggtttaaaatactcttctcctctttatctaccttgaggactcctatctatccttccataccagatccagcctcatcttctaagtgaagccctcctctgggacgtcagcgtctcctctgcatcccctagcattttatgcatcctctgttaaagcaactgtttgcacagctgtatccaccactaaacttagaggcaacagaccatggttttgaatgtgtagaacccaacacagagcccgagacctagtgggtattcagtgcatgttgaagggaagaatgaatgcatgagcaaacaagacaatggaagtctgtcatcagtatttacatttcaaaatgcaaagtgaaaattgtgcaaatctctaatcaagctgtactttaaaatgctaaattgatttggctaaaaatatttcaacactgaaatttctttttgcaagttaagtcttcgcataaccaaaacagaaaagaacgtatcaatgaactaaatagataaatttatggctgacaaaatctcaagatttagtgtgtgagaggaaagtaaaattcaatgtgtccttgaaagttctggggtctaagatatacaggccaatggaatagaatagagacttcagaaataaactattgcatatatggtctgataacttttgaaagtggttcaaagatcatttaatgagaaaaaaaggagtcttttcaacaactggtgttgggaaaactgggtatacatatgcaaaagaaaaaagttgggctcttaccttatactatatacaaaaattaactcaaaatagaacaaagaccaaaaaataaaagctaaaactctaaaattcttatgagaaaactctaaaatgcttagggaataacttcataacactggatttcacaagcctgtcttgaatatgacaccaaaagcacaggcaacataaataaaagagacaaatttgcctgcactaaaattaaacacttttgtgagtcaaacaagctatcaacaaagtcaaaagacatcctataaaataagagaaaatatctgaaaataatttatctaataagggattaatatccagaaaaaaaaatatatatatatatgtatataacctacaactcaacaacaacaacaaaaacaacccaatttaaaaatgggcaaaggacttgaacagaattttttccaaagataacactaatggccaataagtacatgaaattatgctcaacatcactaatcattgggaaaatgcaactcaaatccacaatgaaatacttcgtagccattagtatgactattaccaaaaaatcagaaaattacaagtgctggtggagatatggaaaagttgcaaatcttatgcactggtggtgggagagtaaaatgggaaagtcactataaaaaacagtctagtgattcaaaaattaaaaatagaattaacatatgattcaccaattccgcatgaagatagcaggaaattgaactgatatttgcacatccatgttcatagcagcattatttacaataaccaaaaggtggaggcaacccaagtgtccatccacagatgagtggataaacaaaatgtgatatacacatatcatgggatatcttcagccttagaaaaggagagaaattctgacatatgctataacacagatggacctttggaaagttaagagattgtcttatttatcttacgctaagagaaataagccatccacaaaaggacaaatgctgtacgattccacttgtgtgagttacctagggcagtcaaattcacagaaacagaaagtaaaatgatggtttccaggggctgagagaagggtagaatggaaagctattgtttaatgggttggagtgtcagtgtaagaaaatgaaaaaagttctggagatggatgatggtgagttttgcaccacaatgtgaatgtatttaataccactcaactgtacactaaaaaatggttaggatgataaattttatgtatattttactataacaaaaagtcataaaaatcaaacatggttcttctcattaaaaaaaaaagaagattcctgggtctagttggttctccctccttcttagttcttggatcaaggagatagaattgtgtccaaagtgaccaagtgacctacggagtaatgggcttccatctagccactccctgctttatgactgagctgcactgggagaggcattgtcaggggaaattccaggtttctagaattggtatctagccagaatttgtcccagggctaagtggctaaggcagtgaactagtctgtcagcttctctgttttaaatggagtcatgtaattccattacataccctttgctttcaactatatggccaaacatgactggccagcaggctgggggacagaagacatgtgggcttgtgcttgttacctggaattgaaaagagctcttggcatggttcttgttcaagctccatggttgactagcacatgaccaccaagagagctactgtacttctccgagactcattttctcttctgtaaaaaatgactgagtttctttcacagtgcataaatcttttcctccaggaacagagactgcccagggcctgtccaagacaactaggaaaccagagcagcagttaagccattcctgggcaggaataaatgagcagatgtcagctctcagaatctcagttttctcactcataaaatggaaaagaatactatttcttttatgtcattcaccatattgtgagctgaaggcactttaacgatgctgaggctgtaaactaatgcataatgtgatgtttatcattcttcacctatgttttagttactgagcatctcctgacaccagagaggacgcaacaaaaatcacaactcctagaactgcacagtctaaatggcaaccactagcccctgtgacaactgatcacttgaaaagtgagtagtccaaattaagatgtgctgtaggtgcaaaatatatgctggatttggaagatgttctatgaaaaaagtatctcattagtcatttttatattgattacatattaaaaagattccattttggctatgctggactcttcagatatatcctgggagattgtattaaaagaaaatacatgatggaaattagtgtaggtagttactagaaaatgtaaaattacatgattcacatcctatgttcactgttctagacatataaatataactttgagttatttttaagcatgagaagacagaaatcgacgaataaagtgaaaaagctaaagattaaagatacttacaaatcattgttgtattttttaagaggtcattttgagcatattccttaccattgaagcccctgcctgtctggctcctctgcccaccttgttttgctaatgggtcatgctcctatatgtgcatagacgaggagcggctctcagggactgaccgtaagcatagtcagcacagcacgtatacccatgctctgaccccaggttggcgtcttggagggtgaagcattttcccagtccttctttgactcatcacagaggtataaaacagcgtctccaacacgtgatttttttttttttttttttttgagacagagtcttgctctgtcgcccaggctggagtacagtggcacgatcttggctcactgcaacctccaactcccaggttcaatcaattctcctacctcagcctcccaagtagctgaaattacaggcacacaccaccacgcctggctaatttttgtattttagtagatacggggtttcacaatgttggccaggctggtctcaaactcccgacctcaagtgatccacccatcttggcctcccaaagtgctgggattacaggctgagccactgtgccagttaaaagaaaaaaaatattcaaacatatttggtttcttattgaggtgaagttcacataacatgaaactaacagttttaaagtgaacaattcagtagcatttaattaacaatgttgtccaaccaacacctctgtctagttccaaacatttttgtcaccccaaaaggaaaccacgtgctcagaaggcagtcactccacatcacccctcttcctagtcctatgctttgcacacaactgactcaccctgacagttataacctaaaagttaaataaaattattagtaaactgcaaacccctggcaagtgaattacttaatatctcttaaaatcctgacatcaaatgattcccctgtgaggccatgagatgataagaacatccacctccctctcttgctccagtggaatgaaaccccctcctcaaggagggttacactcaggcataggcccgatcactcatcatatattgacagatgtgcaggcctgagaccccgccttctggagctttctaatgctccttgtttctcaatccaatccttgctaggaattaggctcttctgctgaatgtaaaatttttccatctgcctccataaagtatgtgccacctgtcagctgactggtcaaccccaagctcaaagtatatggacattttgggggtgacaatggtgggcatacatctttagcaaagattaagaaggtaccagaggaggaccagcacaacccagcaatgcagcagaatccatcaggaaagctttggctctgggtggagctccttgctttagctctgcctttgagcgcttgggtggctggggaggcactggggtggaagggaaggaagcaggaattcgtgtgctgcaaatttcactacacttgaccacaacttggagtggaaagggcactgtggtacgtctatctggccttcctttacaagccttaaaatgctgtggaatccatctggatggaagacgccatccaattataaatccttaggatactttttattgccctttaagagttccgatgcttgctcttccatgcccatatgtttctgcttaagaggcttcattcaaatcaaattggaagagaagtccagattacccaactacaattacctgagcaaaaatcccctcaattatcttggtaatccagataaattcggagtacaaaggtgagttgcctggatagcactggctaagaactgctttgtctcccatttcaccttgcattattataatctacttgattacacttcatttataacaatagggagggcttgttttatgccacacattgccacttgctcaagtgtaaaataaaccttaaatgactgatgtactgctaaatttatctcaaaaaacaatcataacaggaatcttaaggcaataaagtcaaacaaatagaattttacagaatttaaaaattattttgtgagtgatttatgctaaaatacctcaaatttatttcaaaaacagtcttacttaaaactgacttaaaatatatgtaggataaataatttgtagtgaatttaacgaaacttcagcaattcaaatgaatgcacattattcttcttaaaaacagatatcctgaaaatatccatcaggataaatagctaatgcatgtgtggcctaatatctaggtgatgggttgataggtgcagggaaccaccatggcacatgtttacctgtgtaacaaacctgcacatccggcacatatatcctggaacgtaaaattaaattaaatttttaaaaagcagatatttggaaagtaccaatagcttcaaagtaaaaatactctacactgtttttgtttgtttgtttattttcgtttttgtttttcttttttgagatggagtctcgctctgttgcccaggctggagtgcagtggcgtgttctcagcttaccacaacctctgcctcctgggttcaagtgattctcctgacttggccgtgccaccatgcccagctaatttttttacatttttggtagagatgatggggtttcactgtgttggccaggctggtctcgaactcctgacctcgtgatccacccgcctcagcctcccaaagtgctgggattacaggcgtgagtcaccgcgcctggcctatgcactgttaattttatcacgacagttataaatccatcaagatgtcctgtgatttttcaacacaaattactcaaattatgaacttctctgtgtgtattttccactggcttgtttatgaatcctgctgatatgtctgctacaatttctccaaaggctaaaagatgtttacaggacaaatgacatcatgaccatgtcaggcttaaatgtgtttatatcagttgggtttagagggtcttcaaaacatggctttaaaatctcagttattatggagcttaatgtgttcctgatgtttctggagtaatgtatttctaaaaatagagaaatagattggttaaaagaaaatgaattgttggtctaatctgtcttatgcatggctaacgaaatgcattttcactctcttccgtgataatacgacacttaaaactgtgaggaccaatggggtgataagagacaaaataaacagtaaatagatactccatgtgagttactactctgtaatagatagaaaagatattttatagaaaagggaaaatacccacagacatataagcaatgtcctgtggttgctatcaaatttactgttagctgtttaaaactgccttaaaggttttttaaatgtgtcttttctaccatagattctttagacgacagccatcaagcagcaaatacctcgcaggaggccattgtgtttctatttgaacttctatggatgtcaagctctgttcttcaaaatttagccctacagatgggtggcccaccggagagaattaatctcactatgcagccaacactaccctttctggatctttccccagtagtgtggattctgctctagtccagaattatgcagaataagtatacttcatcttagacaccataattcttcaaatatctaaaatgtatattatgctctccaaatcctggtcatctccaggttaagtatctctcaaaaacagtccatcagataatatgattttaaatctttatccccttggtcatatacccacaatctcattctatttaccaatatccctactgatgcataaactacatatgtatatgtgtgtttttttttaaaaaaaaagcaattccactgtaattttagcagaggttatttccacatagagctatgtatatgtgtatatacacatatctttatattatatagttttctgtgctttcccagttatctacaatgggcatatatgacttttatagccaggtaattcaatattcattcattcagtgaacatcattgagcatccactatgggctgggaagtgaggatggagccacaaacaagcaaaataaaaacccctgctcttgtggagttcccttctcattggaagagacgtacagtaaagaaaaaaataaaagagtaaagttaatagcctgtgagaaggggatataaaagtgggaaggaagacagggtgatgtgtgagaaacactttttttttttttttttcagatgaagtctcactctgttgcccaggctggagggcagtggctcgatctcagctcactgcaacctccacctcctggtttcaagcagttctcctgcctcagcctcccaagtagctgggacttcaggcatgcaccaccatgcctagctaatttttatatttttagtagagacaggatttcaccatgttggccaggctggtcgtctcaaacttctgacctcaagtgatctgcctgccttgacctccgaaagtgctgggactacagcaatgagctgccaagcccggcctggggaacactattgaatagtgtggtcagggaaggctttactgtgaaggtgatgaagacccaaagaaagtgaggaactaagtcataaatgatgggtagaacattccggattgcgggagcagcaagtgcaaaggccctggggtgaggaataccaagaatgtttgtgtgggcagagcagaaagaaccaagggtaaagcattaggagatgaggctgaagaagtaaccgggatcaggtggttagggccctcaggccctggaggaaggctggcagcgctggagccacatggactgacaatgtctagcagtcatcccggctccctgtgaagaacagaccctcgcttgcagagaagcgaggacaattaggaaagcagagtcatgatccacgcacaggatcacggtgacttggaccagaaagagagcagtggagctggggagtgactcttttcagtatttctcaggtggtaccagtgggatctgcagagaatacatagttaaaggaaatgtctggaactaaacatgactcttcaaacgtgatcctactgtggcagaagagaggcgactttacatttcctttcccaggatatcttattctaatgaacacagaaaccgtaaaatcaagccaaccaacatgatgaaaatgattatataaggtacacagcccaggctggatttgaactgatgagggaaaaaaaatctctagtgaaaattcctctctctaaccacagccttctctccttccatctctgcctcacccttgctctttctgaagccttcctggatgctcatgaagctctctccttctttgactcatcctattttcccaggacctttatcaactcagggctcttctcccctccccacagtcagctcactgtgctctgactagttccctgaaattgctcatcctcttactaaccaggaagcttctacccgctcttggtcttctttctccaccccagtgccaaagaactaagcactgatggagaaaaagcatgcggctaatactgtctgtctctaccacaaatctcataatttttaaaatccatttggaatttacattcactccttaacttcttttcattcactcctaattcacttcctatataattctctacacagctgctgaaaaccttcctttctgctgcctcttaccccaaaactactctcacattactcacaaaggttgaccttgttttctatatacttttttagagtaacgaagccataaaatgtaagttctttcaacctggacctcccactcttgggatttctcaatagcttcacctgtattctcccccttcactcttgactcagaggtaaacgctcccttgctcccaaatcctttagcaacgtagggttgataattgctcctttccaaatttaatccctgcatctgcgcccctgagacagacactgccatgatttcccagcttgctgtcttctccctcctgcatctcctccctttctctgtgacggatattttccctgtgcaagagaaatttcttctgccctaaaataaataatccaaaacatctcttgactccacttaagctaacattcaatatctcactttcccttgtattaacaaaagttaattgagtcagtacggtgctacaattctcagacacaacgataaacatgatagagaccatcaacatgccttggcattttgcctgctttctcttcaattacttgcaacttggcttctactgagctccactgaaaaagctttcatgacatgaccacatccaatcccaaagaaactgtccccttgcccagtggtcttcaaaaccctccaactccacagtgtctcattaactccaactcatttcctactaaacatctcttctcagctcttcaaagtcaaagattgcgaaccaaatctacagacttctcctctcttctcctttgggtccaactccatccttctccatgaaacttcttattcctagaaatggtgtctgcaccttttaggcttccaggcttgagcctagagtcatctttaactctttccatacccagactcccaagacccagtcagctgtttaggtgtctcctctgtatgcagcacttactgtcattgccctggtccatctcccagagcccacatcttgtcccactgtctgcaaagcctttcctatatgctggatataagtgcaaactccccctaaaatcccattgaagtttttacttttttctatcttctttttttacttctttttatcttcctctactcacacagaagtgctccaattatgaggaccttattttattccctttactgtcaaacacaaagccaacatgccatacgaaaagatagtactgtgcttccttcagtgccactctagcacgcccactccagcacacccttcttgtgcgggtgtatgctcatgtgatactatcacaggcaacacttactatgcaatacgttttccacaatcacaatatttccacaatattgtgatatgagctcattcttcaggccttgacacaagcgcccacaaacctaagagaatgcattttcatttttatgatacacagttttcgactgctccactctggctgccaaggcattcctcctccaaatcacgatgtctatatcaaaagaagaacaatgagggagagctggaggtagcgctaagaaacaacctggtccagctcccaggtctcatagagaacactcagaacacgcttgttagaggtatctgctcctggcctcagcttctcagaagcaattacacatcttctgggtaaacgtggagtgtgcagcacagaataccaaagctgagcttcccattgtacctggttgttgatctcctcgttgacctccctcagctgaatatttcttaagaacagtgttcaattaatccaactatccctggtggctggcaggatgaatcagttatgacttatttcatgtttgtgggtgggtgtatgaagtggtcctcaaaggagatttttgctctctgcagacagtctgcctgtctgtaggtcacttcctgccatttcctttgagtgggaatatgagccagggtgttggaagaaggaagagtccaaaagatgtctcagggaatgtcccatagccattggcctggtctgccctagataacttctgagccaggtcaccctaaagtgctacatgaaaagtcatggattttttttctaacttgttgatctcaaatgtcgtgatttggcatgaatatctagcttcccatgttgcagctatggatttattcttgccaaaatattggggattgggctggagagggaagaaggtacgaagatgcattctgtgttgctcaacaagatctgcatggcctcaaccaatgcgtgtttgaccatatggatatttacaaaccccaccatcaactcaccaaaatgaagagtgtcttagacttattctcacaagacaagagggaacgctgcctctaaggagtctctctgggacacctgggagagatttatttaatggtaaagcaaggaaaggaaaagatgaacagtgacctgcaaatcattaaagagggcgactcgatcataggcaagggcttttattagtgctaaaattccacttcaaagtttgctgattcatggatgctttttgttttgctgtttatgttgtagaaactgatttgattttcatagacaaaataactaggcatttataaccacatataggtatgaaagaaagataaaatgatgcccttagcccagtcagaaatactcttaaccatcaaaatagttccctgaatctaataggccaacaatattccaacaccagaacctttgctaccatagccagaatttttaagactgcaccactgttaagtagaggcaatttttaatacttagggtctaaccacaaggcataaaatgcaaaaaaaattacataatcctgtactttttaataattaaatgaaaatacatagactctaagcaggaaaatatctgagatccttaaaacggtataatcataattgttctacattggtaatatgtgtgatgatatttttctccaaaaaaaattctctaccatttcattctctttaatttcttctagcccgtaaggtctagcaaagaggaatacctgaaaagatgcaaattgtacccctgtgctgttcaatgacagcaaaaattgcagctccccaaccccacctcttatgtcccctgagcaatctgtgatcacttgagggtgaggacagtatattgccccaataaactggctttccaccaagtaccaccaagaaatcaaaacagcttttattttattgtgtcatcatatataagttaatagttcataattagttcaaaatttaaaattatgttctaaaaataaagctttctaagtcaatgtaggcaacgattccaagatccttatagttttcctctcttaaacagagaccattatcatatgatttttttttttttttgagacggaagctcactctgttgcccaggctggagtgcagtggtgcgatctctgctcactgcaagctctgcctcctgggttcacgccattctcctgcctcagcctcccaagtagctgggactagaggcacccgccaccacgcccggctaatttttttttttttttttttttttgcatttttagtaaagaccacgtttgaccgtgttagccaggatggtctcgatctcctgacctcatgatctgccagccttaacctcccaaagtgctgagattacaggcgtgagccaccgtgcctggccagtcatatgatttctaaagagaaactgaacagttatttgtagaaactctgcaaagcatgactttgggacgggcacagtggctcacgcctgtaatcccagcactttgggaggctgaggcgggcagatcacgaggtcgggagatcgagaccatcctggctaacatggtgaaaccccgcctctactaaaaaaatacaaaaaaattagccaggcatggtggtgggcgcctgtagtcccagctacttgggaggctgaggcaggagaatggcgtgaacccaggaggcggagcttgcagtgagccaagatcgcaccaccgcactccagcctgggcaacagagcaagactctgtctcaaaaaacaaaacaaaacaacaaaacaaaacaaaacaaaaaagccatgcccaagcccacccctgaccagtgaaatctccgggattggggcacaggtataatgtttttataaacatcttcctagatgtttcctgcatccagggtgataaatcatcatactaaaggcatcatctgaaggctcctagagtatagagaagttcagaataaggaccccaaactattgcacatcctgacactaactagctgtagctgtgcaccctggacagggagagatctaaacagctagttatcttacttcaccgaaatctacaactaaagatgtctatccacgtgttatagctttggcttccctaatctagatgttcaatctacttttctgcaatttggcaaagtaaaacacacatatacagtaatgcacaatgtcctgattgttggggtttattatttgttttgcatttacgcttcttaggtatgtaacatgccaaagtcatgggagctgagtcttttgaaacagaggcttctttgggtgcaaatattaattttctatgaaaaaaagagaaagtacaaagaaaagaaaaaacagcagtaatacagaaatgaatatcttccttgtctaggacacagtgttttttttaacctagatttctttgaacacagactgacacaaaaattaaatactattgctccattggagaggtgcaaacctggggcggtgagagtgaggggaagcgagtgagattgtcactacactagcttctggggacatggagacagccagtcactgagcccctgccttcccttggccatgcagatgcctctgataggttacacggaaaaattctacctcacagcagcccatggggtggaggaaaaataggaacttagttgcctacattcttcctgcatccccttcctcattggtcagagtcaccctgcatgtctgggttgtcacctgctcccaaggtgaccactccaaaagtcaggttctacgcccggtggtggggtgcttcatccaagtacagaaatgccaagaggatccggaaaccttttgacctggttgctgagtcacaggaaagaagggccagccctcctgggacaggtaacaggctggccctgagctgtggaagccctcacacccagaaggagtcaatctgctggggtggccactgagaccaagcaggagctgagggtcctggagtaatagatggaggcccatgagatgtgttcagacacatagtgtgtttgtcaactgcaatgtgtgtgtgcccccaaaattcatgggtttaaatccttacccccaaggtagcagtatgaggaggaggggcctttggaaggtgactaggtcataaggatggaggtctcatgaattgcattagtacctttacaaaagggaccccagggagattccctcacccttttgtcacagtgtgaagacccagcaagaagatggacatctatgaatcaggaagagagccctcaccagaacccaaccctgctacactctgatctcagacttccagcctttagaactgtgagaaataagtttctgttgtttatatgccactcaatgtatagcactttgttacagcagcccaagctaagacagcctattatgtatgagcaggtggctttgagataattgagaaaacagagactataactacaaccagccagagatgggatcattgcaaatgggactcgggttcacacaaggtttgtgacacacacacaaaaaaacataaggcagataaatcagcaagggtagcagtcaggaattgacagacgattaatggattgaggaaacagaatagataatttaaaagcaaacctttgtacacaaaagaattcaggaggtgataaaagtaacattttcatatcagttggaaagtaagttattcaatagcaacagaacaatcatttattgaggaaaaataactatttctttcctggttcaatcttggggtgttgtatgtttccataaatttatccctttttttctgggttttctaatttttgtgcacagaaatgttttttaatagtctctgaggttttttttttatttctgtgggttcagtggtaatgtcccctttgtcatttctgattatgcttatttggatcttctctcttttttctttatcagtctagctagttgtctatcaatcttatttattctttcaaaaaaccaacttttatttttgttggtcttttgcatggtttttttgtatctcaatttcattcagttcagccccgattttggttatttcttttcttctgctagcagtaagtttggtttgctcttgttttttctagttcctccaggtgtgacattaggctgttaatttaagatctttccaactttttgatatcagtgtttagtgctataaactttcctgttaacattgctttaactgtatcccagagattctggtatggtgtatctttgttttcatttgtttcaaataatttattgatttctgtcttagtttcattgtttacccaaaagtcattcaggagcaggttgttcaatttccatgattttgagagatattcttagcattgattttatttttaccgtgctgtggtctgaaagtacggctagtatgatttcagggttttttttcatttgttgcaaattgttttatagccaagtgcgtagtcaattttgaagtatgtgccacgtgtaggtgaaaagaatgcatattgtgtcgttgttgggtgcagtgttctggagatgtctgttaggtccatttggtcaagtgtcaagtttaggtctcaaatatgttaagttagttttctgccttgatgatctatctaatactgtcagtgagatgttgaaatctcccactattattgtatggttatctaagtctctcactaggtccctaaaacttgatttatgaatctgagtgctccagcattgggtgcatacatatctagaacagttaagtcttcttgttgaattggaccctttatcattatataatgcccttctttgtcttttttgatcattgttggtttaaagtctgaaattgaaacgctgaacagaccaataacgaattacaaaattaaatcagtaatataaagactaccaaccagaaaaagccctagaccagagagattcacaaccaaattctaccagatgtataacaaagagctactaccaatcctactgaaactattacaaaagatttaggaggaaagactcctccttaacctcattttatgaggccagtatcattttgatacagaaacctggcagagacacaataagaaaagaaacttcaggccaatattcatgatgaacagggatttggaaatcctcaacaaaataccagtaaaccaaatccagtaccacatcaaaaagctaatccaccatgattaactacacattattcctgggatgcaaggttggctcaacatatgcagatcaataaatgtgattcatcccataaacagaactaaacacaaaaaccacatgatcatctcaatagctgcagaaaagacttccaataaaattcaacatcctttcatgtttaaaacactgacaaactaggcattgaaagaacatacctcaaaatactaacagccatctatgacaaacccacagcaacactgtactgaacaggaaaagctggaagcattccccatgagaattgaaacaagctaaggatgcccactctcaccactcttagtcaatatagtactggaagtcctagccagagcaatcaagcaagagaaaaaaaaaaaaaagaaacaaaatacatccaaatgggaagagaggaagtcaaactatctctcttcacagaggacgtgatttatgtctggaaaacctcattgtatctgtctaaaaactcctggatctgaaaaacaatttcacaacgttttaggatacaaaatcaatgtacaaaaatcagtagcatttctaaacatcaacaatgtccaagctgagagccatatcaagaatgcaattccattcaaaatagcaacaaaaaaaatacaatacttaagggtacagataactggggagtgaaaatctctatgacaagtattacaaaacaaagatcaaagaaatcagagatgacacaaagaaatggaaaaacattccatgcccatggataggaagaatcaatattgttaaaatggccatacttcccaaagcaacttatagattcaatgctatttctatcatattactaattacattttcacagaattagaaaaaactatttggaaattcatatggaaccacagaagagcctaaatagccaaagcaattctaggaaaccaaaaagctgaagtatcacactacctagcttcaaactatgccataaggccacagtaaccaagacagcatagaactagtacaaaaacagacacataaaccaatggactagattagagaacccagaagtaatgtcacacatctatagtcatctaatcttcaacaaagtagacaaaacaagcaatgtggaaaggattccctattcaataaatagtgcttggataactagctagccatatgcagaagattgaaactagactctttcattttaccatatacaaaaatcaactcaagatggattaaagacttaaatgtaaatcatacaactataaaaacctagaagaaaacctagaacataccattctggacataggccctggcaaagatttcatgacagactccaaaagcaatggcaacaaaaacagaaattgacaaatgggacctaattaaactaaagagcttctgcacagcaaaagaaactatcaatagagtatacagacaatgtacagaataggagaaaatatttgcaaattatgcatccaacaaaggtctaatatgcagaatctataaaaaaaaacttaagcaaattaacaagcaaaaaacaacttctttaaaaaaaatgggccaaaaaaacatgaaaagacacttctcaaaagaagacatgtgtgaccaacaagcatatgaaaaaacgctcaacatcactaatcactagagaaaagcaaaccaaaaccaccatgagatatcatgacacaccagtcagaacggcaattttaaaagtcaaaaaataacacatgttggtgaggctgcagagaaaaaggaacagttatatgctgcgtgtgtgaatgtaaattagttcagacactgtggaaagcagtttggagatttcccaaagaacttaaaatagaactaccattcaacccaataatcccatcactgggtatataaaggaatataaattgttctactgtaaagacacctgcattattcacagcattattcacaatagcaaagacatagaaccaatctagaagtccatcagtggtggactggataaagaaaaaaatgtggtacacaaacattacagaatactacacagccataaaatagaatgaaatcatgtcctttgcagtaacatgaatggagctggaggccattatcctaagggagttaacacaggagcggaaaaccaaataccacatgttttcacttataagtgggagctaaacactgagcacacatggacacaaagaatggaatgatagacaccaggggctgcttgagggtggagggtagacgaagggtgaagattgaaaaactaccaattgggcactatgcttattacatggtttatgaaataatctgcacaccaaactctcatggcatgcaatttacccacgtaacaaacgtacacgtgtacccccgaacctaaaataaaagttagaaaggaaaaaaaaaaaactaaatccctatctcacattatacatctaaaaaatccaaatagattagatttaattaaaaattaaaccataaaacacagaaagaaaatacagatgaatagttatataatttaggatgagaacagcctctgtcaggatgaactaaagaattcacaaaaaaaaatgttaacaaattaaatgacatgttaaaaatctggccaggggtagtggttcacacctgtaatcccagcactttgggatgctgaggcgggcggattacctgaggtcaggagtttgagaccagcctggccaacatagtgaaacctcgtctctactgaaagtacaaaaattatccaggcatggtggcacacgcctgtaatcccagctactcaggaggctgaggcaggagaattgcttgagcccgggagacggaggctgcagtgagctgagatcatgccactgcactccagcctggctgacagagggagactctgtctcaaaaaaaaaaaattaagaaactatatattgaaagactataaaaaatagttttggtttttttctcagtaaaaaaataatatatccattgtcaaaaattttctattttcaatattattatttaatagaaaaatttcaacaatttctggagaaaatatatgaaacacatttgacagagttttaacatccttaacataaaggatgtaacttatatgttacatccttaacataattttctttgttcagttaacaagtttttattgagtatctatattgaaatatgcactatgtctgacactggcaacacatttgaggaaataaagaagaaaaattcaagtccacatggaaaaatggactaaggacatgaaaaagtataaatcatcagtacacttctaataaagttaataatcaaagaaatgcaaataaatgtgacctatcaaggtcttgctatttgtactgtcaaattataaaaatacaataacaaatattggcagatattggggaaacaagtaatgtcatatactggtatgtgcttaaactggtaaaagtcttcagaaaggaaattggaaatatatgtaaaaattttggacagttgcatattctttgttctagaaattctacttatatgattagaacctaaggaagttatcatagatttaatcaaagatagttacaggatattcaacatagccctgtatataacagccaagaatctgaagccaacaaaaaatatttagcttaaaatgtatagaatatacataggatgaaattgcataggtcactaaacagtttctagggacatggaaaaaaaaatgccatattgcagaaatgcaatattttgggatgataaaagggcagtttcaaaaaattgaaaaaatagcagttactatgacctcttttggcaaaaataattatatgtaatattgttcatggaaaaatagactggaaatataacgattaaaatgttaattgtatctgggttggtgagattacatataattattatatataatctttacttttttagattgttgttcacagtgacatcaagatttgtcatgggagaaaaaatgaagaagattattattttgtagtcacccaaggagagaagaagtcacatctctggagataggaggagatagggcatatgagccaatcacatttctgcagccttttgtggatacaaaaggggtgggccaagcctttccaatatcccttttcctccttggtacccagacagactatatttaccagcctcctttgcagccaggtgtggtcatgtgactcattcctggtcaatgaaaggtagatggaagcctggcctaggaaacaggtctacatgcaatcttccattcttctcccacccactggctgaaaagaaaggcttctgaggacacagagtggggggaaggctaggtagaggctggatgggaagaaagcagggttctcttgctcctctcatcagagagctactgaggagacccaccgcacccagacccccatactggactgttacaggagtgagaaataaactttgtttagaccactgaaatttgagagttagagctattagcctaccctgattaacgctggggtagcccctcacatctgcccagcaccctcagcagagcctaacccaatcatccaaggttacccaatagagaactcaggcttccactagagtagccgtcacatagagttactgggtcttccaggttctgccacctccaccgtgttttgtgggactctccactgaactcacaaagcacatgtattcagctactccaaagctatgtgtactcaggaagagaaagttctaaatgtttctgtgaccttgtgccactgatatcatgggttctatccttcagagtgctaagaaaagtgttaaatctccagaatagctttggaaaagtggagaaatttgagactttctctatttttagttgctaatatgcattcctgaaaagtttatttaaagccacaaggaaatatttccatattgaatttcaatattgcaatatactattttagaataaaatggaaagatccaggacatagagcagctgagaagctacacagttggcccctgggcttcactcagacagtgcttctctaggctgcaagtcataagtctttgtgtcacccacttttagaagacatcccccggacttctgggaccaacctgaggtttgtaggaatctctgaggatcaatgatcaaacatatattagcttgaaaaaaaactaatatatgtgtatgtttttttaaaaggttaagtttttaacaatttagacgtcttggcattatactctgagaacgttaaccaatgagaataagagtgacaatttagatgtaaaacctcttaaaggtaaagataaaatcctaaccacatggggaaaaccatgtgttctgtggatgatttccctggatttctcaaaagactcttagaatgttctgggtatgactttgggggcatctgttctatgaagatgggcaccccagcatcacctgcatattaacccttcttcttgctcctaaagatgcagaattagctgagattaggaagatgtacaaagtgttctccctgcacttcaactaatgaacaaaactttttaaaaattacttatgatttggaactattttatcattttatatatcctatggcaactggcattttatatttaattttatcatcttttgctttttttctttgatctaaatcaggatgctaagttttgggggggggtcctacagttttggcagagacctcattctaaaaaagaggtaccagactattaaggcagaatctgctgagggtggccccaaacctggtctggtgaacctcactcaactcatcattgatttcaagggcacagaagaggcaaggagatgacagcaggagaaatggacatgtaccatggagaaaggggaccaaccacaccttctgtccaaactgagatttcccagcctgaaacaggtcaacactggggttagcaagaaactttaaactgaataggagattaaagtaataagaagatgagtactattattggtacaaattatattggtaatagttttaagtttcattctttaagacagggtgaatcacagtcccttctctcaaggtccttgtcagcattctacttttccaaggacattcaaaaatttctcatccaaagtcaaacattagtgtgtgtgcctcaaacaagaaatagttttccatcagtctccaaatctttgaatagtaaatggcaaaagtatggaaatgcaagatggagtggggcttaatgttgccacaacattcctacaatactgggatagtcttccttgggaattactttctttcctatcacgtatcaataaggaaagccaaatgtagaaataaagaaatctccccgatttacttaacacacggaggtgacagttacagcgcaaattgagggaagagtaaatgatttccacaaatgaaccaaaaacacttaaaagccacatttaagagaaatggagtcataaaggcaatatttgtgagcagataaaaaatcagcacagaaaaaggtgagaaatacacaatgtctttcatcaaggtgcaaggaaatgtaaaataacattaaaagtaccaactacataatttgaatataaagagaacaatagcaagaaaggagaggggaagtgatggcgatatggagacacagtctcttttgcatgcacagggcagaaccggtgcctcaggctggagggtgtctgtgagtaccccacaatgaaagcaaaagagcacccagcattgaagccacagaccttgctccatgaatcctagctgatgggctggcacagagagatcaggagcagaacaaggaaatccataggaggatcctcccaaagtacttttttttctggtccaaaaatccttaaatctgtcagaagcaggaggttggagtgggagaattgcagagcctggaacacacctgcctgctgatgacccattctgagggggttctttccacttggcagcaatggacttggtaaaaaaaataatagatccttctccatggatcccatttccctttttttttttttttttttttttgagatggagccccaggcagaattaaagaccaactctgggacccaaatttttagaggacaaaggttgatataatggccagcacgatttagtcatttagatttcaggtctaactaactgatgacagactttaacaaaatcactgaaagaaatttaacgtcaaccttaaataacagtagaggcaggtaatataacaaatagagtcaaaatggtttatctaaaggtctaagcccaagaaacatccaacaataaaattaatctaaaacaaattttttaataatcatttttttttcttgagacagagtttcgctcttgttgcccaggctggagtgccatggcacggtcttggctcactgcaccccctgcctcccgggttcaagtgatttcctgcctcagtctcccaagtagctgggattacaggcatgcgccaccacgcccagctaatttttttgtatttttagtagagatggggtttcaccatgttggtcaggctggcctcgaactcctgacctcaggtgatccacccaccttggtctcccaaagtgctgggattataggcgtgagacaccacacccggcctcatcttttctttaacattacaatttcccatcatggtggcacttgacagtagtgggactgtccaacagcaaatgaccccatctaagcactcaggacagaagccattttaggtcatgaaaattatacagattttgtgagtgaagggcatttagttctgagcagaaagtagtcttgcaaaagggaaatttgcaacaacaacaaaaaaggacaaggagggtgacaatgtcaagcaaatgataaccctgctggagcttcagaaggaaccagctacatccctttcctgcttctacagatgctatggcagccccagaggtgtcccactaggatctcccttcaagaaagaatctagcatgcatctgaacaacctccagctgttcacacctcaggccctgcctcatcccagacagccctgagccaatcactgacacagcagggtactagagcctggtcatttctgcccaacccggggcccctccaaaggcaagctctgctccagacctccccgttgggttggtcaaactatcaaatctgtacctggtctgaggctctccctgcccagtcttgcttcatcctcattttatccttcacaggcacagcccccttccccctccaataaaacactaacattcctaattccgtctcaacatctgcttcccagggaacctaactaacacaatactcctaaaaccaataccagcaaaaagtgactttccaagcccctacatgaagactcattttctggaaaataaaatttaatataattccaattacccatgacgctatttagccatttcaaaggaaatgagaaagcttcccaaattgtggtcctcatggagtgaactgatcatcaaatgttgctgtttacatgagggcacacaataattagggttgtatgtaacatgctactttcagattttcaggtaagtctaaatgcttttaattgatgcaagaataataagtccttcagttgatttatgtcatgcattaatatcaatcaaaaggttttctaacacatactttttaatactataaaatgtggggttttttttaatgtcttttttttcttattcagagccacatttcttcacatggtatgttttacctaacctaagggttatgttgttcgtttgtttttaatttcaggtttgaggaatcaagtaacaggtctttctaaatccttttattggatatatgttagttttccattatcataaaagactgaggaacaggaacagcagcatattgtttaaatgattcacaggtaaaaatatcttctccctcttggtctgttttctttcctgatgtctttgctcattgccaacattgtctattttatatataattcttgcaggacattgtgccctgaaggtgaaattggacaggtaaggagatgacccaacaccccttgtcacacctgcaggctctaggtcacttttgtaacacacaatgaaatgggtaaattctacacaatcctttttttttttttttcaaacaataacagaaagtaaatatttgaactgggggctttttcaaacaacacaagtcagaaaaaattgacttgtttttgactgttactttaggcatatatttttgattaatgacaattaaatgtaaatataaagatattttaaacttgaggttttaaaacaaagaatgcaagaatcacctggttaaagttagatattttgtcagtctcaaagtcagttggctggataataccatatcataaaattttataagactaatttgaaggtccatatgaattggtattattgttcgtttttcaatattgatcttagcagtgtatttacagcatacagcagagttaatgtttaatacaaacaaacaagactttccagaaaatctacaaagaatcactaactaatagccatgcttcagttaaatttgtttactttttaaagtacattctcagaagtaacatgtactctcaattaagtaaaacacaaccagaattttggaatttgatctttaaaataataaaaaaactttctctgctatttacagccttggttaaaatcccaacatctggataccagaatctgagcagcaaaatccacggagacacatgtgcaattttatgcctgcaagctcactattatttagaacgaaaccaacgtagtgcatctacccttgtttcttgctacacagaatgtatccagagtacaaactaatgtagattattataaaactcagtgtgtagatattatatatatatacacatgcatacatacacgcacatatataactaaaacaaaatcttcaaaaataatactttttctttctgtatgtgatgtgccctgatagtttccactttactccatcccatttccttttgttaatactggccttgactcacttagacaaatgggtcatgacctgtagtttggaaaacagggctttccagcctggctttaaagaggctggtcctcaggccagcagaaccagcagcacctgggggtagtttgtggcgcacaatctcaaggcctgccctagacctactgaactaggatctgctcttagcaaggtccccaggtgacttatggatgtattaaagtttgagaagccgtcctcctgcatgcaaaagtacagaatgagtatctgtgatctgaactacatttaaatcgataatgcacctcttaaactgtctttgttcaaagaacttctatcctactgagctcaaggagcaacacagtttctagcaagataggtgcaaagaaaaattcactttcaatttcatcaactgcttcaagaggttgcagggactggctgacctggtatcccagctcctgcaggaccgagagtgtgggaggtgggttgaggggaggtactgaattgactgcaatagatccatgagcatataaaagtgtgcgtgtttgttcttattcctgggagaaaatatatagtattcacctaattttaaaagagttttatggtttaaaaagttaagaagagctactaagccatgaaaagacgaggaggaagcttaaatgcacattactataccagataagaaaatctgaaaaggctacatagtgtatgattccaaccatatgacagtctggaaatggcaaaactatggagatgtaaaaagatcagtggttgtcagggcctaggaggtcgggagggatgaacagacacagctcagtgaatttgaggggcagtgaaactaatctgtatgatattataatggtggatccgtgtcatcacctgtttgtccaaacccacagaacatataacaccaagggtatacggtgtttatattaaagtataaccctaatgagaactctggactttgggtgataatgatgtgttgatgtaggttcagcccttgttacacgtcagccacccatgtgggaaaatgttgatagtggtggaagctatgtatgtataggggcaggaattatatgagaacacttgtggtatatgctcaagtctgttgtgaacctaaaactgctctaaaaaataaagtctgtaggtatctatgaaagcgcagacacatggtccgtgagagcacgtcctctctgctataaattggttgtatggttacaatcatacctagaaaggagagaaaataaagagtaagtgaataccgacatgttcaattctgccccagaatacaacaaagtccctgaatcactcttgtttcattgttgccattgcttattcaattcagtcaactcgtatatgtgaagcatgtgctacatacataacgtataatgcaggatgcaaaaatgattatgtgatcacttcaagtaatttataatctagcaaacatataaaacaggcacacagataatccttacatagtaaatgcctcctttttccccaaaatggcaaggagacaaatagcaaggatccgaggacagagaggcaaaattcagaaggccagaaaggcatggagccagaaatccaattcactcgcgagtaaggtatcgggagagagtggtgtacaacgtgacagggacacctgttgctcccaattgtaatcttttctgattggtttatgcccctttccaattactgtgtccatgctaattatcaactatttttattatcaaccctgcagaggggactaagagaaaaaaaaaaactgctgcaaagtgatgctgtgttcattttgcacagaacccagaaatcctgatgaaggaaactgaattggatgccacaagccttatctcctgtgaatgctgaatgactttgtcggtgggttttacgataagatgtactttcttttatatctattaaacaagctatacagaatactggtaaatacacagaagtaaaaagaagaataaaatagataaaattttctaagttaaaagctaagggaaaaataaaaagaattatcaattgatgtgatcaaagaaaaatgtttatctcatggggtgttggaaaaggaacatcataaaaattaataggtagaataatcatcaaaaacaatctgcacaacaaatattacatagctgaggggaactatcattaaaatataatgtatacaaattgctgagaaactcactacaccttctaaatcatgtcaaaagagttgtttgcatataagctgtctgcacttcttctctctctctctttttttttgttcatattcactgcaaggtggcttttgtccacccatgcaaatcactcatatgaaggtcacaatgatgtccaggtggccaaagcctgtggctaatcctcagtcctcatctcaccgagacagcagtttcttagcccttctcctacctccactggcttctcttctcagctcctctgtagttccccctcctctttccaacctgtatgcattggaggggcccaaagctcaaccctaatgctcttctgcatcttggtccctaggtgatctcacctagtcacccagcctcagatagccttaggcttaggaatcacaaatatatctctcacatgacctctagactcatatcaacctctcaacatcacaatttggatatccaacaggcatctccaactcaacacagccaaaccccacttttgacttcctgctcattgcaactgtcccctcttgcagatgtcccttttagagtaggtggcaccatcatatacccagttacaaacaaaatctttaaagtcatccttgactctcctacactgcatatctaatccatcagcaaatgctgtcttttccaccttcaaagtagatccccagtctgatcatttctcactacctcccctttcgctgcctggtgcctggcaatggcctcctaattggtcttccctgtttcaactcttggtccccctctagactgttccccacacaacagccaacatggttcttttagaacttcaaccaatgtaaattatacttcaagaaagctttaaaaaattcaatcagatcacatctgctatgaaccttccaatggttctcctcccgcagtgtgccaaataaaatggaaatgcccttatccttgcttaacagaagtctacaacacagcctcaccagcatgcctccaactcacatcctgcagctttaacctcactccacgccagcccccagtctccttgccgttacttgaaagtgccaggagagctcctgccaaagggcctttgcacatgctgttccctctctctgcaatactcttccccgtgtgatcatacggctcatgctcccactcccttcgggtctcagcttgaatgtcacctcctccctatgaccttccctaacctttcgtgtaaaattctacctctcccttcctcagtctcttgcttctcctgctttgttctggagaataccaaccagcaccacctgatttgtaactattcccttgagcacattctatctcagccacgggaatggaagcttcatgcaggcggggacatcatctgttcagttcatgctgtagcccagcaattctgaatgattagattgaaattggatccaaaaatatcacaaatgagataacgtaacttgttgataagtgtgtgaagagtatgaagagatgatcaagctcacaagtttccaagtgctaacatctataaaactccattgtcacccatcaaatcagcaaagattaaaaaccacaatagaatgtgataaaatagtgctctcagatacttcctggagaagtatagatgggcagaattgggtgatctggtatcaatgatcattctttcataccaatacaccatgggattttgcgatcagaaggtaaagaagacacagaaggaaaagaaggtgaagattaaaccagcaaaaacccataataagtaggacttcttcctattcattagtaagaaagagttgggtgtccccatgggaaaatgctaatttagtgtcctgaaccactgtaccctccaattcctgcttcccccacaacagtggccccacactgagtcctacaacgaggataatgatcctcaacccccaattgcacagacagggctaagtcagagacagtgatgccaaccttgctgatgtctctaaaacactcaactactgggggctaaccctaagcaaaattattgactccgattcctaagttaatttcctataaggtggaagaagcaacaagtgtcacttctcttctgggctctatgacaccaaatagtggagccgaagagacttgctgatgttttgaaacccaaggccaaataatgctctctaaacccttagaggtgtgactaggatattcacagaagccacgcaaaagacagcagccttcaatgaagaaacaaagaaacaaaaaacatggttccttttataaatatttatcgattatctaaggctaggttaattgttgataactatcaattatctgagcaagatacgcagaaacacttcaggtgcttgaactgcagcatcctgggctccaacccaaacttactggagaagaagctttagataccaggaatctgcattttaaccaactcctcagggaaactgccccagagggggtctaggctaaccatgcgcaacttccacccattctcctgggaagtgattgtgaatctcctccaaacccctcttacacttcctgattaagttggtgccccctactgaatgtcagcctcactgaatcttaacgaggaatcgccagactgggggggggattgtgcagcatgtctggggaacacttcactacttcactaaaccctgctgcacacatgctgaacaccgttccaaaggctacaggaactgagcaccgcattggaatctggccctggagggtgcccagcatggcgaccctgaggggtgcaggaacccagtgagaaggagaaacagaaggtacagtccagctcgagaccacgcacataaagaaatctgtaggcagggtctctattattgtgccatattaaatatcttgatattttaaagcaatattatttttctgattataaaagtactcattgtagaaattttaattgtgccatcatcctgcagaaaaatgaaagtacaaaaaacgaaaaagcagctatacacggccacaaagtcacagggctcatcgggatgtgctaaccaggctggaaactgatcaaagctgatttattgagaaaaaataggcagcatatcaaagacttacatcagcttcatagtagacagactttgggggcgggggaactctgtctcttttgagtatattctcaaaaggataaactttcaccttcctgtgaagcacagttactataaatcagatttgcaaactgtgagaaatgcttacaactcaatgagtcttttgtcagccagtgggggctccatcgtgaaatccacccttcgccatagcgatgggataaatcatcaccagccccgagacatcgcctaatcccttcctcgcaaggcagattcgggcgctttctgcatctgcttcgtgttattgaaaagagctcggctcatctgctgggctctcaggcttcacagtgacctcgcacagaacgctgctacttctgaaactgttttagactcttccgtctatgaaacagacacagagtttaagtttagcgtcttttatggtcagaaatatttagcgttacttccagagcggcagccgtggaacaatgtgggaaagaagtgcttcagttcacttcttgggaagtactgaccctgggtcaatttaattttttccgtaagatttccccttcttacttttctccttccactgctatatgtaacagtatctccccttccactgctatatgtaacagtatctccccttccactgctatatgcaccagtatgctagtatacaacattatagattaataatatgctatattgtttaaaaatattaatgttatataattaacatggtgtgcatattattatattgacaatacgtaatgtgatgtgataataagtctcactgagtgccaggcaccgctttgaatgctctaaactcattagctaatttattcctcgtgattctatggggtagatgcactatttcattcccattttacagctgaggaaactgaggcagctagtaacaggtggagccaagcttcacactgagatcatctggccccagcacactcataaaaatgagcaaaagtataaaagccaaagggaaaaggaagccaaggggtgaaaatcctaattacaaacaaatcctgggtaagctgggtttttagtccttccccacatgtgaacagcaactagaaacctgaacagtgactttgtttcccctgtcatccattgttggtgcctgatcctcacacaaaatcttacggagcagtatctagtgattagcttagctgaattgagcctggacacccttcatgagctggaggacagaggacgtgtcgatggagggtccaacttcaggcatctgtactcgcctgctacaggtgagtggacctatgaacccccagcctcatcaagcacccgagggtcacctgcctgcttcacctggaagagacagcaaggtgtgatcccaggaagatcctctgccaggaggcttacaggcagaagcagcggctgctgaacatagatgctgtcggcaggacacaggggtgatagggggtgagccagtggagcaggtgaaggtgcagactacaggcagcccccctgagatcctgcccagaccccagcagcagctcccctgtccctctctagcagcttcgctgtgcccgaagtgtttgagaacaggtgacccatgccctgagtggcagatgctgtgtctttttgatcccttctctccctccccccccacccccagtggggtacatggaaggtttgctaaatgtttgttgaatgaataaacgagcccaagtcagaagcagtctccaaatcattcctcatcgcaaaagggtgcggtggaaaaactcacaaagccaaggcaggaggacacactcaacttggaaacggcccgtgcccagctttggaacaggcacagcctgagcttcaaggaagtcacttgaccagcagtagctcccacctttccttgcagctagaacagcatcagaccaagtgatctctaatgtgatgatttgctaaagtacaatgagttttacaactagaaagtaccttcctctcaagactgacttcactatgagccacctaatttttcctctctcttcttttggtatttttgttgcaaatagtacacacaaaacaggatatataatctatttgtgcaatttaaagaataagaagcaaacacctttgcaggtactccctagtccacaacagtcagccccaggacctcagaagccccttatgcctttcccctaaaactctcccctccctgacaaggtaattccaatgctgagttatgtggttttttttccttatttttcttttcaacacatattacgtttctctgaataatatgctttttaatgttgcctctttttaatctttatttgtggaatcatattgtatgtaatctgtgacttttttctactcacatatgagaaccatccacactgatacatggctacagatagacacttggagtttatttttcactgctgtatagtactccattggtggagtacaataggtttatgtatccacttttctgtagatggacacttgggttgttctgtttttgctcatacatacctcctggtgctcaggtacaagggaatacagacccagggtgagactgctggatcacaggctaggcacatcttcagctttactaggtaacaccaagccaatacaaaagtgcttgtacaaactcatgctcctgccagcatggaggacccactgtgccacataaaaacatcactgttattaacttgttttatttgcatatgattattttttcccttatccccaaccacttctcaaagcaactagccagcatgtgccacacaggcaagcacccactccaatgtgatctatatggttaggtatgtatgtaccctggaaaaccctgtgatgttgcttgaggagtatataacttttttatgtatgtaagtagcatgtgctacaaagcgcgttctgttttctgtatttttcactccactcagtgttttgtaaaacatgctcatgttgctccataggtatcagagacaggatgatgttttatctttaagatgggtacgccaccctcattttatagatcacagtgatagctcacaattgtttagtactcagtggggtctaaatgtactaactcgtttaatctcccacgaaccctgcaaaacagatgcttccgtttcatataaaatgagaccaaggcacaaagaaactaaggaacttgtacaaaatcaccaagttagtaaacatcagagcaggatttgaattgagccagaatgtgttcttatccacgacatgaaactggataagaatgcaaagctcagagaattttcatgactagcatctctgggattcacagctggcgaccacggagcagaactaatatacagatggttcccctctcagtccagtcctcattccatcggctccaaaatgtgtattattctatatgattagctggtgaacaacaaaggcaattagttagtcctcttcagcaaatgttagtaaatgaaaatattatagagacagaactctttttaggaaatgcaatcatgtgaatttaaaaatgctttatcagaaatagaattaatgacaaaaatatttataggatcctaagaaaatggatttgctattttttttgtcggctgatgataatcatctgggtgcatctttggttgtgacagctccaccccttcagagagttgtatcttcatacacacctaacatgctaagagtagatgtgcatgatatggtagttagtataatttctgtaataaaaaaagtacttggtcatgcctgtaatcccagcattttgggaggctgaggtgggaggattgcttgagcccagagtttgagaccagcctgggcaagatagtgagaccttgtctctacaaaaaaaataaaaattagctgggtgtagcggtgcacacctgtagtcccagctactcaggaggttgaggcaggaagatcgcttgagcctgggaggcagaggctgcagtgagccataatcataccactgcactccagcctgggcaacagagcaagactatgtcttaaaaaaaataaataaaaataaataataaataaaaaatttttaaaaaaggtacctggaacggcctgcaaagaaagggaaatcaaattatgcttcaagacagtcactattatcactgacagagaagcagctaaaataaacagcctgctcattttgtttgtaaatgaattgccacaattcttgcactatttaaatcaagaatattttatattccatagttttcaaccacccctcctttttttattgtttccagctccttaaacatataaaaggataaaagccatttgttctggcagaaaagagtcatcataaattttgcagagtgaatttctctaagatgaaaggaatgttcctctcctccaggacagcctacggacaggactgtgatgacacagagtcttcacgggaatcacacctgcagtgttaagccacttctgtggaaaactcaagtccttctcagataacaaaaacattttagtagcaatgaaccaaaaacaaaatcttccactatatatgttaatacatcaaaaggaaccattcatgtgccatttataagaacttccttccggccaggtgcggtggctcacgcctgtaatcccagcactttgggaggccaaggcaggtggatcacgaggtcaggagattgagaccatcctggctaacacggtgaaaccccgtctctactaaaaaaaaaaaaaaaaatgcaaaaaattagccaggcgtggtggcaggtgcctgtagtcccagctactcaggaggctgaggcaggagaatggcgggaacccaggaggcagaggttgcagcaagccaagatcgcgccactgcactccagcctgggcaacaaagcgagactccatcaaaaaaaaaaaaaaaaaaaaagaacttccttcccagaaatcatagcagcgttcctcagcccaaagccagaagaaacttctcgcacatgaaattttacttcaaaaactcccatatcaggcattttaatgaatcagtggaagaaaattatcctcccaactttgttgtcaagaaccccaatttcatatgcagaaaaaagaattacaaaaataattattcgaattctaattggtgggattttgataggtttataaaggaaataaatatctttaacacaattctacctcgcagccaacatcagctattagcaaccacacttcttattgccagttcatctctccaaacacacagaagccatgtgagttgaaatttattttttaaaaactctcagttatgatttctcaaaattatatttcatatattgacatcaaccaatatgatgatgatattatatattgacattaaccaatacgatcaaccaatatgatgataattgtagggaaaagaaagagagatctgactgttactgtgtctatgtagaaaggaaagacataagagactccattttgaaaaagacctgtactttaaacaattgctttgctgagatgttgttaatttgtagctttgccccaaccactttgccctagccactttgacccaacctggagctcacaaaaacatgtgttgtataaaatcaatgtgtaagggatctagggctgtgcaggacgtgccttgttaacatgtttacaagcagtatacttggtaaaagtcatcgccattctctagcctcaataaaccaggggcacaatgcactgcggaaagccgcagggacctctgcccttgaaagcggggtattgtccaaggtttctcccatgtgatagtctgaaatatggcctcgtgggatgagaaagacctgactgtcccccagcccgacacccgtaaagggtctgtgctgaggtggattagtaaaagaggaaagcctcttgcagttgagatagaggaaggccactgtctcctgtctgcccctgggaactgaatgtctcagtataaaacccaattgtacatttgttcaattctgagatgagagaaaaaccgccctatggtggaaggtgagacatgtttacagcaatgctgctttgttattctttactccgctgagatgtttgggtggagagaaacatacatctggcctatgtgcacatccaggcatagtaccttcccttgaacttaattatgacatagattcttttgctcacatgttttttgctgaccttctccttattatcaccctgctctcctactacattcctttttgctaaaataatgaaaataataatcaattaaaactgagggaactcagaggccggtgccggtgcaggtccttggtatgctgagcgccggtcccctgagcccactgttgtttctctatactttgtctctgtgtcttatttcttttctcagtctctcgtcccacctgactagaaatacccacagttgtggaggggaaggtcaccccttcagataataagataaatcagagccgaaaacatagttcattcctgaaatcaaatatagaacgtttctaccaacacacattttcaaagatggtgttttcaggtttgtatgggattgtttcacctttatgaattagctttttaaaacctgtaatactttcttgctgacttcatcatttccttctggttgcctggaggggtggtgtggaatgctaataaaatgaatttcagttgccgtccctcacaatctgaactatagaagatatttattgtctcaacttccctatgagcttttctttgcatcatgcagcttcatggtcagcagacactaaaaattaaagaaagtctttctcccactttacttgtgtagcacagacacactgatcaaatatgttcccagcacttccgaagaaaccttatcacatccacaagagatttcctacttgcactttttttgataaacacaaccatcatagcccaacaaaacatcacacagaaatcaaattatagtgtccccataagcatctgctcctctatggccttgggcaaaatttagaatcctcgacatccctagagttaccacaatctctgaaagtgaaggagcacccacaaagctcaaggaatgcattgaaactcttattacttccaattccattttcaaaaaaagtaaatgtgtgtgtatgtgagctgcacatggtccagaatgcctcaccaaatgtattgttttaaaatgtgtgtacgtccatgtgtaattgtatgtgtgggattttgaaaggctttttatattttattcaaaaaggtacacttttcaatatcacaaactttgctttcaattataagcccttcccattttcaattaatgttttaggcaaggaatatacattagtaaaaccaaccacaccacttagggaaaatgaattagtatggggaaagtgaagaactggccatgcagtcaattactttggccagcatagatatagttgaactaaccagcacaggtgtagacagcctgtttggataaggtagcttaagccccaattttttctgcagtctttatttttgtcaaatatatgaaaactaccatctcatttcctccctgtagctattacccacatgtatgtgtagtgtcaaaataaatggccagagtcctctcagggacctcccttggcacaagtcgcacttcctcaccctctcacctccagagcctcaggaagtgcaggtcagaaagcagccagggcaggtgtgaggtgatggagcgctgagtgtcggcgagcccagataaaacaacgttccaacatcggaaatccaatcattcacctacttgtctcctgctcgctaaccccaggcaagtataaaggagatggaattataacaggagttagaagaatttggatgtgatttcatatattaactcagcaaaattttttctgaaaaggtccagacagtaaatattttcagctggcaggccatatggtctttgtcgaacctactcaactgtgccattatggagtgaaggcagccacagatgatatagaaatgaatgcatggggctgtgttccaataaagctttctttatggacactgaaatgtaaatttcatgcaatttacatgtgttacgaaatatgcttcttttgatttttcaaccatttaaaaaagtaaaaaccattttcttagctcctgggctgtgttgactgacccctaattaactgatatgtgggctgctatccatgaaaacctaggcacagaggaaggcagagctggcttcccagccaagacgggacttaccttgatatgagctgctgggtccgggacagtctgaatcatgtccttcagtaagccagcccatctaccagctgttcagaacctgacggctagaagacaaaaggaacaacatacataataataaacaactgcatttctgtgttttatgttctagcaggacaggacacaattcaccaatggcaaaagaatcatagctttacattaaacatgtttgcctaaaggcatcctctaggtacgtgtggtccatgaggtgactagataactcacttcccttccattgggaaaatcacttacaatgagcccaagagaaccctagtccgacaggacagaagaatctagctcaagctaacccacatcacatgcagcatccacacatccttccacgtgggcagcatctaatgagggatccattaaaggaagacgtgggactaaaacagggcatacttctctatcatactgagaaaacaggactttgaaatcccaccaaaactcatgcgatctgcacatccttttcagctttgttattaagttcttagtaaacagcacagctaccattcattgagtacttcagcgccagttccttgagcgctaagggctccacacacattttctcatttcattccaaccacgactctgagagctgtcattcccattgtccagctgtggacgtcaagactcataaaggttactgatttgtccaggatcacctggttaataagcgacagaaccaaacttcaaatcagattaggctatctgactccagagcccaaaaaaaatttggtttgacttaattagcaggtatcaacccacattttgaagggacattttaaaacaccgcttaaataaattaaatttaaagatgcctataatccaggaattttccagaaataaatacttcatccaatatattcctttattcaaattataaagcagcatgttctgaccactgtctgtgccctccccttccaccgagccagtctccaacctccctttgctgtcacaggccccagggctgacctctacagatgggctcagcagggtgccttgcctcctggccacctgtcagggttggttgacgtggccccctctggagagcaggggtgagaggagaggggtatctcttcccctcaccttcccaccaccgacacctgccgcccaacctccctgggcgcttggttatggttctgactgcagctggattctagggggacctctcccgtcatggggcccctccttccaggctccagcctccagtacctggtccccagccagtctctggtgctctgcagatctcagccaagccatcagttcttttttggcactaaaaatgccttttttagtttacatttttagaagccatcacttgctttttatcacctgtagttttttgtttgttttctcctttacaatggctctttgcagtaacaaatgcaaaataaaaataaacaatatgattacagaacttgagacattttcgaaggctgtctttcaaatttgctactgagcgcattactgtagtgacaagtgaaagcattcacaggagtcctccccacattcacatctgtcctttctgacctctcacggtacaggcacacccattccaacccaattgcctctcatgaagagcatctacctccagatctgcatgctccacatctgtcttcagtctccctggaggcctcccaagattggcggagcttggctcaccaagaagatgacatgctgggaaccttaggcattttttttctataaccaaatttctaggtcttggaaaatatgtacttccccccacccccacccccaggcctaaagtccctctgggggatgagagttactgaaagtacagagggagtgaagtgcagtcctgaaattgaaccgggaagcagatgaaggtgaccaggctcctggtgctctcgtgggagaagaggctgggagaggatggggcctggctgaaggtttctgggagcataggaatcctcaactccccttatcctaagagcagcaggtgccacaggaaaacaccactctgctcctggggtcattcagcccggaaggggagcgtctgcaagccatcctcacaaagggagggcgtcccactgcacaaccctgctctggggagcacatggctatttccgtatgtctggacattctctctggactagttcactccgcacagttcctccctgcctgcacacacatgctgacgctcacaccagggactgaagctcgtccccctcccctcaaacccaggctgacctgtggctgcctctgacctgcagaacacagcagagggaaggtttcaggagtcccaggctcaggcctttatggaagtgggagcttccccttcctgcctcctgaaaccaagtccccataccctcagcagcacagcacatggcagaggaccgagtgcccagtggggcagccagcaccaacgccaggcccgggagggagttgtcctggacagtccagagaactgactctcagatgaccacggcccctgccgacatcagggaggcagcttccagctgagtccagtcagcccacagaatcatgaccaataataaatgggttgttgtactaagctgctaggatttggggtagtttattacacacacaggtcattgaaacaccctgtaagtgctctagaggcacggagaagatagagggtaaatagcttgtttcactgtcactatggataagtacaaagatggttccaacactcaactcctcctgtacccatgctttttgccacataactttgtgattcttcccattaaagaggtagaattacttcccaacccttatttttgggcggcctatatgatctgcttcagccaacaggcagtagcagaaagacaagtatgacagatcctagctgaagcctcaggaggcaggacatgttcccctttgcttttctgtaactttccaccagcatgggaacatggccagatgcatgcgggaggatgagaggtacctgaggcagagtcacccaccccaatcaccccaccaagactacgtttgatcatcccatagacaaccaaaaccccagacatgggagggaggcaaccagaccagccgctagccaagtccaaccagaatggccaacccacaggctcatggctgaataagtgcttactgcttgaagccactgaaatttggggaatttgttacacagcatttttgtgacaatagattactgacatacactttgcaatgtacaatcagattaccgagatcttcgttaaaatttttctagccagtgataaaaggagactcaaacagggcatttcaaaggaagccacttcatcccaacacagagacataatatttccactcacctacgagacatgatctcaaaccctaatcctgccctcaaaatgggtttggaaactgaaggataaccaagaaacctccaccagaagcctccatgggattcccagagcccttcccaggagcaactgaattctcacttcacatgatgccctgccagcctcccctggattccaaaaatcaaaacatccttggatatccaagaccgcagcaacatcatagaagttacagcagccactcggtctgtaaccaaccaagacataaactaaatgagcaactgtttgagtctcttgtttcttatggggaagttttgagtactcaggttgcatcaagtataaaatgacagggaagggaatagatagagattccagatgcaacacagtcctgatccttgagggatcgagatgggaaacagatctgtttcatacagatatgaagcggtcagtcctgagagcaggcagttagtggaggtgcccagtgaggcgtgtggatatacctagaggaaagagagagctgattcatgcagagacaagagggtgccaccaaggagccttgatgaacaagaagcatgaggactggaggaaagagggtgaaaggcatgaagcagggaacctaagtttctcccagctctgccacattagagaccaagggcgtatgagcttctcacaccgccaccaccagagtgatcacacaccaaagggattcactcagcacgcagcgtgatggcactgccaccctccacaccagctcagcgaaaacccaacggacctaaagaccaggagaataaaagctcaaccaccctcccctgcctcctcaacccacacggatctctgactctttttttttttttgagacggagtctctctctgttgcccaggctggagtgcagtggtacgatctcggctcactgcaacctctgcctcccgggttcacaccattctcctgcctcagcctcccaagtagctgggactacagccgcccaccaccacgcctggctaattttttgtatttttagtagagacgggatttcaccgtgttagccaggatggtatcgatctcctgacctcttgatccacccgcctcggcctcccaaagcactgggattacaggcgtgagccaccacgcccggctaattttttgtatttttagtagagacggggtttcaccgtgtcggccagatggtctcgatctcctgacctcgtgatccacccacgttggcctcccaaagtgctgggattacaggcgtgagccaccacacctggccctctctgactctttttgcagccatttgagtgcctgttcttttttaccatttcagaggtattttatggattttttaaagagtacttctaatttacttttgtgttcctaatggtcatttctcaaatatgtagtagttggtaaccaaacaaactaaaaccatactaaaaatttttagtagttggtgatagtttcatgtcactgtaggaacctttttattttctattttacctgcctttgaacccttgcagaacttcactctatgttgattgaaaatcatttctttaatacttgtttcttgcaataaactcatttgctaaggtatatacttccatatgattttgtgtttcatgacccagctatattttattattgggtatcttaaagaaacaaaaaaggccttaacaataacagaattctacttgtgtcacttctttgtttttgttttcaaaatgccaatgtcttactaaatagaaacaaacttgatttgaattacgtaagctctaaccacataaaaaagatggactggtacccaaggtagaagggaaaataagcattttgtaattatggaggcagtattgcaaaatggttaagagaaggcctaaatatttgcagggctggtgcaagaaaatagatggaagtttgagacccctcgaccctacccctcctctcttctcaaacccaattgtgttctgcgggttaggggatgcatatagtcacgtggacatcccgatccacatggccacactccattcagcaatgctccctgctcatctttcagacccagggaaacacacacaagatcttcccaagaagatgaactccaggaaacaggctggtgcagcccaaaagatgctcagtcaagtttggaaaggcactctgggtgccccagcacctggggcatgtcctggaatggggatgggttcagctggggagggcaggaatggggcctagaaggcataggcaggacgctgggctgggggcagtgctcgatatgagcacagtgcagagccagatgagggatggaaatcagatctgccacttactccttggaaacctataaatgatcactttatcctccaagagccttagttacacatttgcacaatgaggataatattactgtagtataataagaactccatttgcccttgtctctcgtttctggcatggagctcctaaaactctgggaatttcccaagtgatgggagcatcttttgttctaagaaggcagcaggttggtgagtccctagatagcttcaggatgggggctaattgcaagaaagagtgagtcttgattagatgctcagaaccttcagccccatttcccaacctctcaggagaggagaggagctagaaattgagttgatccccagtggccagtgatttaatcaatcctgcctatgtaacaaaatctccataaaataccctgacggggttaggacagcttctgggctggtgagcatattggtatgaagagtgtggtgcaacccaatgctaaagggacagaggcggccaggcgcggtggctcacgcctgtaatcccagcaccttgggaggccgaggagggtggatcacgaggtcaggagatcgagaccatcctggttaacacggtgaaaccccatctctactgaaaatacaaaagattagccgggcgtggtggtggacgcctgtagtcccagctgctcaggaggctgaggcaggagaatggcgtgaacccgggaggaggaggttgcagtgagccgagatcgtgccactgcactccagcctgggcaacagagcgagactccatctcacaaaaaaaaaaaaaaaaaaaaaagggcagaggctcctgtacttggaatccttccagaccttgccctgtgcacctcttcatctggttgttcattcatatgcttaataataaactgtaatcataagagcatagcgttttcctgagttctagcaagttgttgcacctaaaaggggggttgtgggaacccccaatgttgtagccatgtcagacagagtgtaggtaacctggggacccaatacttgtaactggcatctgaagtgaggacggtgttggggagctcagcccttaaacccatgtgctaacttccggtagtcagtgtcagaactgaattgaactgttggacacccagttggtatcagtgttgaatgactggttggtactggcgaagacatgatgtatttggtgttgggaaacatgaataaaaaatttgtaaaacctccaaacgatgttcagcaattcacaaaggtgtcagtgcaagagttggcctgtatctattctaactggtcagtatgcaagttgaaccattgtttgattatctcctctgtctacaccatcaggcttttgtgaggattaaactaaattatgcctcagaaagaaaactctctcaaggctaggcacataatcaacactaaacaagtggtaatcattataattaagaaagtaaaaatatttcaaatggacgattttgatactgtataaaatgttgcaacttttttttttttgagacggagtcttgctctgtcgcccaggctggagcgcagtggcgcaatcttggctcactgcaacctccacctcccgggttccactgattctcctgcctcagcctcccgagcagctgggattacaggcacgtgctaccatggctggctaattaaaatgttgcaactttttaggaaaaataatcctcaataaataaattgctaattttcataagagccctttgtcaactgactaaaaacatccttaatttagaaatgtattttttagttttaagataactagtcattaagtgaaaacattgtaggcaaaatggctctaagcaatttagtattcataggaatgaatccattccttgaaagcattggtcgctgggtgcacttgtcctggatgagcagatattaggcaaatcagtctttcaccagcaaaccctgccataagaactgcacaggcctgattcctgccaagcacaccaggcccctgactggggcagaggcctcccttatggggcaggaagaaggaggcagggagaaacatagggcccatgatttaaggaggctctccctctcaggctcatgcaagtgcaggatcagtacctaaaggggagcaccgcccgaaatcctgtgccccagtcaccttaacccagtccagccctggctcctgcactccaaagctaagcagggaataccagcgggagacagaagacagcatgagaaactgaatgcatctcccacatttatctaaaaataagaaaatggacttcttcagtaggaaatggctcatctttccaaatgaataaaaatacttatagctatgggttgaattgtatcaattctctcccccagttcatgcactggagtactaacccccggtccctcgggatgtgatgatagagaggtagggcctttacagaggcaatcaaattaaagtgaggtcattagtgacctaacccaatgtgactgatccacttacaaaaaaagggacaagatttaaagacagacctgtatagaaggacgatggtgtgaagacacagggaaaagacaaaagaggcctggaacagattttcctcaaagccctcagagggaaccacttgggctgacaccttgatcttggacatccagcctccggaacggtgagatgatgaatttctgttgttttaagctacccagttcatggcagtttgttacaacagcactgggaaaggaaatcacctctatggagggacttacgaaagtcacttaactaatgcagattagaggcctcacagtcagggcatggcctcaagagccacatccattttaattgtaccatttctcactgaactctgaccctggtcaaggcatgtctcaggctccatggactactattccttccactgatcgaccctggcttcattctggcaagggagggactcatacattctgcggcctgcatgagtgtcatgtgagcacccccataaccttgatccctgcggtgcttctccaggggagccctagcattccagctggcctcatgggcatgccttagagagagggagctgaccctctccttcttcaactggattttatttttattttttggcatgttttgtgaatacaaagattcactgcctgggtgtgccccttgaaagaaggtttcaattgcattcaggtgaaataaccacaaaatgactgtaagccaaatgtagtagtatgatagaaaaatggaaatatcgtaaaagcaccagtctgtagacacctagcttctggttcctctggaaaagggagaagagagtagacagtgatggagaaaagaggggctgtgaagactatagaactgagaaggcagtaattctaaaatctccacactgtagggccaggaacaggcagtgctgggcaatggggcatcttatctcagggaagtcaagggtgtcatgtagaaccaacataattcatccaagtacagcaaagaatccagaaatggtctgtggaggtttggaaccatgaaaatcaaataggaaagatacaaaatatttacatatccacattttttaaaaggggtcctgactaggcagcataagattatttgggttctgttcattttacctttagttgcccttggttctgccatcttttttctctgtgagtcatttgtcttgcttttggtcaacacggctttcctcgggtctccaaagatcctggaataacctgaatataagttgaagaatattaaaccttattttgttttcaaatattaataccagggatcaactgtacatgtaccgacaaaacctatttcttaaacattattttaaaatatcctaaaaggggaaagaacttaaatccttccccttaaaaaaagaggggacaacattcctctcctctgagggaagcccagcattatgaagcaaaaatcgggagtgaaagcaaggccaagcctaactggcatgctgaagcacacagatgcttttgcacagaaaatattttgaaaatgttttcttttccttatagcccccagctttggtaataatggcttccctagatcattctgttagcactttctgctgctcagaacagggtagtgggatttagaatttagaaaacatcccgagaactgtaattaagcaattgtcatagtcccagaaaagaaacaacccttttactttgtaaatgctaggaggatctgtattttttaaaatcttagaacactaactagctaaaaagatagaaagaaaaaaatctttcttacaatatgcctgtagcacggctccaaaatccagtccctctctctcttcttttttttttttttttttttttttttagatacaggaatttcttacacaactttccaagtaaaatattcaatccccaaataatatatttagtagaatccttacaacatgagaaattgtaaatggcatctgtttccgttgaaaatatttttaaattagaaaacatcttaagcactgcatcaaatcaatatttgtaatgggcagaattatttctaaatggttccacaggccagttgacattcccactctacttaggaagcccccagccaactccacctgaagtcttcgaaacctatgcatagaggcaaattgcccagatgtcacagaaaagcatttgttgtgatacagaaaataaaacacattactgggggaaaaaaatcagggtactaaaccacgtacataatatcatcccaatattgcacaaagaaaaaaaaataagtggatgaaataaaagagggaaggcaggaaaggaaagaggatgacctgagaaaagttatcaaaatggttaacagtcatggtctttggctttccagtgtgaaataggagttcttattttcctctttttaaaatatttttaaaattatttattttttaaaccaactaataaaagtaatatatatttaccgtgtacaacattatgttttgaaatatatatatatatatatatatatatatatatatatatatatatatatatatatatatacatgttggaatggctaaagtaagctaattaacatctgcattacctcacatacttatttttttgtggtgcgaacacttgaaatctactcttagtgattttcaagaatataatgcattgttattaactacagtcaatagatcataggtctattcaagttcaagtcacagatctcttgaaattactcctcctgtctaactgaaattttgtgtcctttgaccaacatctccccagttcccctacgctcaacatcactaatcatcaaggaaatgcaaatcgaaatcatgatgagtgtcatctcacacctgttagaatggccattatcaaaaagacaagtgttggtggggatgtggaaaaagggaactcttgcccaccgttggtgggaacgtagatcagtacagtcattatggaaaacaggatggaggttcctcaaaaacacaaagatcaattacaaaacaaaatactatatgttttacaaatgtactacaactcaatttggtatgtattacaaatcaaaatactacatgattgctggcaatcccactctggagatagatccaaagaaaatggaaaatgaaatcggtatgtcaaagaggtaccagccctcccaaattcattacagcattattcacaacagacaaggtatggcatcaacctaagtgtccatcaacataaacgcccataaagaaaagtggtgcacatacacaatggaacactattcagcatttagaagagaaatcctgtcatttgtgacaacatgaacaaacctggagaactttatgctaaatgaaataagccaggcacagaaagacacatactgcatcctctcacttatacatagcatctgaaaagttgaactcctatttccttctttatagttttgtgtattttccaaattttctaaaccaaaaatattcatctttataatcaggggagaaaactaaggaataatcattttataatcctaaacatgcttttaaagcatttatttcactgtaatgtattcttttcccatccagtcatacatgggcccaaggagctggccttccctgctcggcagcctgatgttcaaggggatgggggagggggacggtgcagtagatcatgctttgcaaagctgtgcaaatcttttttttttttttttgagacggagtctcgctctgtcgcccaggctggagtgcagtggcacgatcttggctcactgcaacctccgcctcccaggttcacaccattctcctgcctcagcctcccgagtagctgggattacaggcgcccgccaccacacccggctaatttttgtattttagtagagacggggtttcatcgtgttagccaggacggtctcaatctcctgacctcgtgatccacccgcctcggccaaagtgctgggattacaggcgtgagccacggcgcccggccaaagctgtgcaaatcttgagttaataaacatgttccccaaatccaaaagccaatattgactattgcttggttaactgttttgcatggataagtggttaaaggagtatttggtttccaatttctgcaaagggaataaaagttttaaaagcgtgaactaagatttcctatactatgctattctatagtaggtttttatgccaaaacctctactaggctgaaaggataatttgatttatggttgagacattgttgggcctgatttaaagcccagagtcaagcccagagaggattctcttaaatatgtgcaatgggtatttttaaattagcattatggcgttattaatatttcatttatcctgagagcatttacctgacaacgtaaattatgtgtaacacagctgagaagccacaaaggatccaaaaagatgtcacgaagtccacgaagagaagctttgccagagaaaggcacactaccagccgcgtgagctggcctcatcaaagcaaaaaagtcagaaaattatgtaaaccagactcaagaactcaaaaatacagtcgtttgagaacattggtaagagtgcaaactgctcaccccagctcaatcacccctggtccagcaacggcagaaagccaaggtcaaggagtcacatgacctgaagagacaccccccaccaccaccaccaccctccaagccctgcccctggccagtgggacaaaccacatgacccctgggattcagtattcagtcaggttctgtgttctgtatggggaggtagaagaaggcaccagatcatcaggaaatctggactggaaatggccaaagctgaacacatctgagtacctgaagggtaagcttaaggtgtcaaagcagccatggtgaggcagaaagaaccttgagcttggggccccaagtttatgctgacccactagcagccaacaaaacctccctcagcctcagtttgctcatctgaaaactgtgagtaagaggctctgactccagagaggtggtgcaagttcaatgagaaggggttgctgatggtccagatggacagatgcaaagcactgctttctgtttttgtctttgttttgatacaggattctctctgtcatccaggctggtgtgcagtggtgtcaatagctcactgcagcctggaccctccctggctcaagtgatcctcccacctcagccacccaactagctcagactataggaaaaagagtcatgcaccaccatgcctggctaatttttaaaaaaaaaattttggagacatgagatctcactattttgtccaggccaatctcgaactcctggcctcaagcaatcctcctctctcagcctcccaaagtgcttggattagaggggtgagctaccatgcccagcaaaggcattgttaaattcaggaatgaatgaccaccttgttccccaaaacactagacaagagaaccattctctacgcacagatctccctggccaccacgtgtaagcagcagtgaatattccataggtggaactggctactgtgaagaaagaaaactccagaaaagctaccctcactccaagaagtagcctggaccccacgtgcgtgacagcagcctggggagaaggctccactcccaccagcaatgccaaggacagagcagcagcagccgtccatccccacagttatggtgaacacagccacagagcagcctgctttttccatgtatagccacacacaggtggcaatggcagcagacgtaactggctgcccttcctcccttatggaaggaaacataattttgcttgggtgttctgcctgcccccacatgacccacggaggatgaccagccccaacaccagtgtaaatcctatcactgggcaccatctcttctcaccacggattggtttagggaagggcacatgatataattctggtcagtctaacactcggggaagcgagctagaggacttctaggaaaagtgttggctgatgaagaaaggccatagagtagtagtcctgtctgtgtggcacttggaactgtgagagccatcccaggaccatgagaagaggtcacctgaggataaaaccaatgtgctgtggatatctgggggaaaggagggaagtccttgtgtttctacctatggtagggaagagtataaaccaactctgaaggcatctcatggcagggcagctaggcacatcaaatgcattttccttgttaactaaaccattttgaattggggtcatttttgttgttattgttattactggcagcaaaagtatcccatacactctagtagccatgttcaaaaaagtcgctttcagctcttttaccatctgtatccatagtcacgcagacacgctgagtatgctcttcagttctaattttaaaataaaatgatctgctggaaattagctcagctcatagatctccatacttacaacaccgtatctaagaattagtaaataactattaccatgataagtggcctatctcagtctatccacatgttgagtgtccaggtactggaggtggcatggaacctcccctcaataaacaaaggctatgatgagaggttatactttaaattaaattactgagtggaggcataatgtggtgagggtcacaagagaggtaccaaagatgcagcaacagagcagttgatgggcacttagcatttcagtaagtgggaatggggaggagagcaggaaaggtggaggaaatagatgaggagaggaaagaagggaagtgttctccaaggaagcacgctgcagggaaagagtctttcacctgtatgtcccacaaggcacagagtatgaactcagaaatgttgaatgatttgtctctataattaagggatgatttcactgataatgttgtcttcttccatgatctaaattcaacctgcccttcaaatccattcattcatacaattgttcatccatccatccatccatccatccatccatccatgtattcatgtattcattcatctatccatccatgtattcatccatccatcatccatgtattcatccatccatccacccatccatccatgtattcatccatccatctatccatccatccatacgcactgagttccctccatgtgccaagcactgagctaaacactaactagggttgggctttgccaatgagttcagagcctagtgagagagacagagttgtaaagaaaaaaatcacaaatgccaactcccccattgccttgcttgatccttaatgccagagtgtagcttggttgagcatgacaatcagctggagagctttttaaaaacagaaattctgcaatccttcctcttttttctttattggaaagtccaggggtgaaaggggcaaaagagtctaagtgggagttagggaggcagaagaggattgaaggcagtgtctgaaatattttcagactgagaaggaaaaggaaaacagccaagaacacaaggaggagcagtcagagcataaggaggaaactaggaaagatctaagtcatggaagccaaggaaggacattcagtaagatggaaagttcagtgtcgcaactgcagagagattcatgtccaggagaaagtcattcaaccaaccatacgcattgagaacaggtcctggatttggcaacttaaaacctcttgctgtcctctaaaaatgttgtaggagcctgacagcattaagccaaatggctcagtagttaaaaacagggaggatatgcaaagggcaatgtaggctactcatagaagaagttgagcaacaaagttagggagggagtggcagttcaaagaaaagcactaatgccacagggtgcagtggctcatgcatgtaatcccagcactttaagtcaggagttcaagaccagcctggccaacatggtgaaaccttatctctactaaaaatacaaaaattagccgggcatggtggtggacacctgcaatcccagctactcagaaggctgaggcaagagaatcacttgaatccaggaggcagaggttgcagcaagctgagattgcaccactgcactccagcctgggggacagagtgagactcctcaaaacaaaccaaccaacaaacaaacaaaaccaaaaaaacaatgaaaacaaaaatgaaaagcactaactggcttcacccacccaacatttgctgggcacttactgtacttcagaaattactagtagctagggatgcactagtgcacaagactcagccctgccctcaaggcatttacaaaccaatgaaaagaaggtttatcttatttgctcagtctgtttgaaggatgagaaaagcaggtatgtttatagacaggataaagggagccagtggagtagaggagatagagattctagagccagggcacttaaggacgttactgtctggggaagaggtagaggaaatgccatgtttcacagcacaatggtggggtcagttctggcaggaaggtgggaccccactgtctcagaaggggtgtgctgccagatggctaacaacaggctctcacaggaaaactcctgatttgaagcacttggtcatttctatggagtcaatatttccatcatgggcaactgcaaggaacccaggggagtccctgaatgcagagttgggaaaagatgtgctctaacgcatcattgccggctctagcgagttgggaggagccagctctagcacacatgggctccagaagccaaagagagaccaagaagcctggaactgttgataagaaaagagtgttcagaggaaagctgtgaagccagcatagccagctgctctcctaggcgctgagaccctgtgatgagaggagaaaccagggaggcggagttccaaatctggaaaagtggcaggcttgagtgctcttcagttactcccacttgagcaattttgctttctaaacctggttaatagcccaaaatgtgggctgcttattgtcatctcccttcactgtgtgtgtgtgtgtgtgtgtgtgtgtgtgtgtgtgcttttcctatgtaaactgctgcaccactaactctgctatactttagaactcagtaaggcaatccttagactcttatacaattccctaaagggtccccttttactctaagtcacagagaaatgttgaacatttaaacctttaaagtgcagttttgctggaagaaaatttcaagggtctccatgaatcatgtctgagccatgtattggccatgaccgcatacttcttgtcagtcttatttcatttggttgttattgtggtttggtttcatttcatgttgctttggagggtcaacctttctttcattcatgacattcaatcaacctttctccccagtgcgtcttcccattttttatgtgtgtgtcaggagatagaaaaataaacacaggtattaatgtgcctgtgggcaccagtttgtaaagcccaagacgttcttggacccaaggaaactttcagttctttctcagccttgccgttttgcatgtaaagcatttgagctgatctcagagttgaggtggctgccagcttccaccagaacaaaacacacagcagcaaaacagcgccatgtccctcagtgtgggaaccagggtctgcctggggcccccctgtaaaaacgagagatctgaaggaaaacagacagcatttgaaaggcggatgacatcaagaaagtaaaagcaactataaatatgacttctctcctgctttacactgagccttctgttcaagaaaacacatttaccagggattttttccttaagctcaactggaaaaacaaatatttagtcattttacaagagcagacaactgaaaagcaagccacagattaaacaagcattatgtatttctaagaaagttcatcaaacacaatatatctttgagaacacaatcttgaagtctgttttagaggcaaatttgaccttcaaaatgaattttgtctcgatataattacaaggtcaaatcttaaagaagcaaatgcatagacaaccatctttgcaatgagatctgttttatatttgcaaatgaacaatactggacagaaaaaaaatacataattacttctgaggttatatataaaatacccaattggcaattagctaatatcatattagcatctcaatattttagataaagcaaaactcccaagtacaaaataatctataatagaacaaaaatggcaagtcatattaaagagagattacatataagagactttattacaagttatcattttttagataaaatttattctttcagcatcactttgatacttgtaggaggcagatatagtatagagaggcagatagaggtgagaacctttcctaagaaaaatcaagcagcattaaaagcataaagaaaaaagaagaaaaaatatttcagattcccaattcgtatatcacattgttgacaaaaaaaaaattagagaataccaacaggaaaaggtttccttgtgctctttaagggtggggaatttcaaagaaccttgaactcatcatgaaaatagttctatacccatcggctttgccaaaaacactttgggatttcagtgatgggtactgagccaccaggagcaatgaaaccagcttttccatttccactgagttttgactggtttacaaggattgcacaaagatcacctcatttgtactggacacaattgggaaataaaaatttaaaaatcatccttcatatttaaaatagaaatcatgaaccccgccacaaacatgcttccccgacactcaggacctgaggttgacaacatgcctccccgttaacccatgaagcctcataggtatgcactgcatctatatagaattttccatggactccatcatcaaagcatcctttaacaagtatgaactgagcactcaccccatgcacagagctgtggacggggccatatgggacagaaaagttgcaaggtgtgtctctcactcccaaagagcccacatgccttgcaggagaggaaggctgtggacccaggttttgtgatgcagatgaaggggccacatagctgctccagtaagaagaactggaatcatctgaaggagaggaaaatagggcatttcagccttgaatagcagaacccagatcatgaaaaataggaagaacttatatggacgtcagagaggaaggcaatccagacaacaataataacttaggcaaaacagaaatcaaatgcagcttgcagaagactctgtacagggagccaacacagctactttacgtgaggagtcaatgagaccatttaatagaagccccctgtcgaaactgtaaaaatgattttgccatcttggccatctcctgagatggctgagaagggatttgccaagcaaaaaaagagttgaggggttttgcacaatggcctggaacagagaggctggagagaaatcagacaagtctctcaggcagaagttccagaaaaatgaagaagcaggagagcccgaggcaagagggaaatggcaggcacattggttggacgatgagggtttgtgtggatctcaaagggccaagacgtggggagagtctagacttttaggctaggaagtccgaaccttgttgtgaaaatagctgaagattttggagcacctgccgagcaaagtttcccaaagaggctgttgggaagattcatgaggcaggagactacagggagggaaggccagaggcagagaggccagttccaggatggctgccacgatccagcccaaggtaatgaaggtggggaagcctcggaatgcaagagacagggtggagatgagaagacatgtcagagcctggtggccaattaagcagagaaggtgcagggaagagaggagagcaggatggaaagccaggaaatgtgggtctcagtgaagatggggagttctgtttcagccccaagaatgagcatgtgcatccttgaaccccggggcctgtgaggttggtcaatggaagcccgggagctctgctcagtcagggtctaggactggtactcctgctggggccacctcagagcagaagcagggcgggagcggtggaggctggctctgaagtgttctgcccttaaagaacagcaagactttccagaggcagtgtgtagcctttaagatggagactgtgatgaagaatggagagagatggaaagagcttctcagtgacatggggagagggtccgcacctggagggcaaacccttcctggagggcagaacctcgctggccatctggcttcccacacacctgcctggtgaaccaacatatcactagggggttcttttcttgcttgaaatgtcattgagttttcaatttgtagcattcatgaggtgcattatgaggtttattcagcattttttttcttttgctgagaaaggcacaattaagtaccagaattttctttgctggcctagccttctggaatctgaacaggttttgcaatcccaggaccagatcctctctatataaaaattggtgtgggattggggggggggggtctctttttataatagctagaacatcttaatattttgtaaaaaataagctcatcacgaacccagttaacccagcaaggctactgcccttcttctgtgtcgtggtaacagctttcttcagcagtgcaaggtgcaggcagagcctttcatagttttaatcactaggtccatttattgagagagcttgaaaggtgattattcctgttctcatttctcagaaaactgaggcatgtgaagatcacaggtagggtaagcaaatgaacacaaattcaaactcggaattcaaaaccagcctctgtgtattcctgaggaccatactgtctgctaagtgtagagaaaggcacatcctggttcaacagcagagaaagcaaacaggaggcactttctgtgagtcatctccaccacagggccctctcttttgtgatccagcgatacttgttcacagtcaaagcccaggaagagtggaaagattaacctttgtgagccaaaccgtgtgacacttgattacttgacagaactaatccttctgtcctgatgacagaaattcaactacacaggtacatgcaagctaatatctgttgtaatgcctcccagtttctctggagaattccttagtttcctggacatctctgaaatgcaaagttttggcaacgagtctctgaattaacctctgaaaatctcacccagccaagatggccttcttgagaagactgaagaacatggttggtttcaggctgagctggaagtggtttacctcccaggagaggttccccacagtggtgtttaaggcatggggtggaccaacaccaggaagactcagacatcacaccacccaccttcaactcagtcacatccacctacattttctgaaaacaaaaggcagtctccccaaaaagcactgagactcttgtgtaggtaatctgagcagacaccaacttcccagggcttccttttatccaggagagcttggctgttctttttaatggtaatatcttcttcttcctgcagcaccgggctgtggcccactctggagaaaaggaaagatcattgctggcctgccttcccaatttcagacttgccagtctacaattgtgtaaactaattccttaaaatacatctcattatatctatcatccatctgaatctagatgcatacatatgtatatacacatatgtacacagttataaatatggatcaatataatgagatgtatttttaagaaattggtttatctgtctatatatatttacatacatatacatccatacatagatatctcattttatctctatatctatatacatataaacacacgtgtgtgtacatttatgtatggacataaagatgggtgtaataagatttattttaaggaacttgaaatatagagagatatctatatatatctacacacacacacacacacacacacacacgcacacagagaaagagagagagggagaaagatctatctacatccatcctgttggatctttctggagcaccctggctgacactcctgcattgatgagtcattggttgtaggatgtcctgggaacgaggcatgagcttggacagggctgtcatcatcagcaggcacttcccaaagagggctgacagctgaggcatcttccaaccatactcccagcatctgagggaataagtccttccttcctgaagggaacccagacagcacatcacagagcccacaccaactgggcaaattgaatgtgcacagagtaaattaccaaaactgccaataaaactcagaattataaaatcatataatttagaaattataaaatcatataatttagaaattacgtgatgtaattaacatttgcaatccgttgacttaaagtcgattatgtgggaaataactgagagttcgttaataagcacaaaacaatccagcagaaattgacagcattaggtgctcaggttgtgtggaggtcaatctcagcaaaccagagtcactgggctccctagatggagttaaggaaagccctgatcttggaccagccacgtcctttacacatagcaaggactgtaagcccgaccttgctctagcacaggaaggaggagggcttccctctaaaaaccacccattttctcccagaaccccaagactccagtccctgtcaggctgcagaggtgatttccaaccatctgatgccacctgcatcagaatcgctgaggcattcctgggccccatgccccattcctggagtcagcagccggactatgagactggctcagtgaaccccacagacagggtcacaggcatggaagcgcaggcagcagagtgcaggcacagaggctagcagtgaccatccacctggccctgaacaagtccaccttctcagagttttagtttcctaacctggaaaacagggaataatatcatgaaagaaacaccaggcacagcactaatgtatcacaaatgccacataagtaactgagtgcaaaatgggacatttcctgccatcggctgaggctcagaatagcacacagagcacagcagcggtgcactctctaaaaaaggatgcccgcacatccatgcacaactctctaaggagtgacctaaataacaacagcaagtccctgcccctctgccttcccggcctcaagggtatatatgtcagaaactggtcaatgctgagtatacagctcccacagtcgcagaggggagcagggtggatgtgtagagttttctggtttctgcacagtataaatcctcccacaatttcaatcaaccaaaggaggagttgggagacatctgcacaattagctcttgtgcaccggcactgatagaagagaccagagacctggcattccttcagagaaagtttcagaggctgtgcagcacctctctccaccccagggaaagaaaggaaagggggacataggcagggaaatttcacatccatgtgcagatgcaccaacctcaaggccagtgagggaagcttcaaaaaaaccatttaggctgcctccaagggttcccctagggttctgagctaccagggcacaggggctagtgactgccttccaggtagagaagtttgcagaggctgcctggggacaggtaagaaggagaggccatgggggggcacactgagcttccatccatggtgaggtgagagggcctgggtatatccttgtacccagggacccatggcaggtggctggacttgcaggggtgagccagccctgacagaaagaggctggaggtgtaccagggtgaagctaggggaagggtaccatcagcagacacacacagggatgtcaccctgccatggagagctgtggggcaatgtcactgcaagagcccttccgcaccctcccatgcattccatgaacaaggggcagcttttagacctttgcttcacagaggggaatccgacaccaaattatgatgcatggccaagtaaccccattaatagcccttgttgtcctgtcttcctgctccaaccctggagaaccagaggcagaggtcagtggtaaggagaggagtgggtgtgcaagcctctgaggctgggagccggccatggccccagaggcgtttccgatgctaacaccagctccggatgcaaagaatcttgaaacaggacgaacaataggcttttaaaaattcaacttccctggacctctcaatacttggaaattagactgttcactgtatctagaagtgacagggaaagtctggtgcctgaggagactcggaacagggacaggaaggagctatcagacttgaggcatgagtttggaggaagtaaagttgcacctacatcataacctactgagaacagctcattcagaaaacaaagaagcccagtttctcatatgttgggtgggtggccctgccaggtaaacctgtagcaaagccacatggaaataggatagtgtcaaaaccaatcaggccaagagtgagcaacagcccactgggtctctgaaagagctgaggaaacaagaggaggcaaaagaagtgatctataaggcacgaggttggtgacagggccaggaagtttacaagagcgagcatatcagatagacaaacaccaagaggcagaagagtctacagatacaaggagatccaaacctacccgcaatccccacccaaccccgccccggctttggctaccctggggctggcgaaggtattaagtgaaaacacccaggtttgagaatggctgggcatcaaggcagttttgacaacctcagaatcaggaagtatttgcctgcaggccagtagctgggagaaatgtccagctctacgtagatttctgtagctggggtcccattttccttcaaggtgggatgggtaagacagaaaacgtcccctgaaggacaagactcaggacagctccagcctagtgtctcccggtccctgtttgctccacaggagaaagaccctccagagtgcaatgaaggggcccagaggggacagtaaagggaccccatcccatgtggcgactcccatcatggcagaactgtagaatccaacatcacatggacctcattgataacactgaccacacctccttgctcttaagatggataaagggcagggacaaggggctccgttttatttgaccaatagctgcaaaagtaagaaatcgtaataagcatggaatcacagaaccagttgaatgtagaattaaacaattaaggcacatttctggcttaaagatgccaagaggtttttgtttgtattctttatgttttttttggacaaccactaaacacacattcagagcatcttctataagagccacagagacatcccttgagacttcagatgatttcaaaactctgctatcgctccttgaaaaaggcaagcctgggattgcaacctatccatgcatctaaccccccctggaaatctctggctccaagagtctaatggtgatggctgccactattagatttcctttctctctgggcattacaatcaggtttacaaggaagaaacaccacccagggttatcacctccaccagtggacacagagttcaccagcttttattgccgggactgacagatgtcaaggggatcactggattccaggattgacaggatggaacggtcagtaggacgccttcccccaacaactcagatgacagagtccacaacgcggcagccagatcaggcaggaatcccacctaatgtctgaataacaccactgataggaatccccactgaatcccaactgaaggctcagttgtacactgtgggcccaaaatacctacaacgttttacaaaacctaaagaaaaggcagatctctttggtggcaaaggcaatgtggtgagttaactttgaagcaatccaacaccatattattgtcatagacatgctcactaagaaaaaaaaaatcatacagagaaatagaaaaatagagagataaatgaataaatatttattttgaggtttcactgccaaaggctagccagagaaacaggggagatacaaggtgaagattggaatcacaactaaatattgttcctgtataaggagaattttccctgtttgaattcttagattacttgactccccgagtttctcattcctttgacaggcacccatgagtgttacactccaagcactcaccctcctatttccatgtgccagcatttccagtcactatcttgatttaagtagagaggataacagttttctcctacatagtaactttaaaatagtaacagttttctcctagaagcaacttaaaataaatttattgacattaaaaaattttaaatgaggtgtagtcaaagcttaaccagcacttttttaaaggagcatattttactttatttttatttttatttttattttgagatggtgtctccctctgttgcccaggctggagtgcagtggtgtgatctcagctcactgcaacctccacctcccagattcaagcaatccttaaagaagcatatttcataaagaacacttctgagtcacttctgttgtcttcctgagtgctttttacctgctctttgcatgtggcataaactcctgcttctctaatgcatctcagtttttaacttttggctctttcactgcaaacataggaatttttaaaataaagaaaccacagccaggcatggtggctcacgcctgtaatcccagcactttgggaggctgtggcaggtggatcacgaggtcagcagatcaagatcatcctggctaacatggtgaaaccccgtctctactaaaaatacaaaaaaattagctgggcatggcgatgggtgcctgtagtcccagctactaaggaggctgagacagaagaatcccttgaacctgggaggcagaggttgcagtgagccaagattgtgccactgcactccagcctgggtgacagagcgggactctgtctcaaaaataaataaatacataaataaataagtaaaccaaaacagttgtacaaacaccagatattcaaacatcaaatgacttgataaatgtggactttaacggggcaggggataaggaagggaaatgcagcaactggtgcatttacagcaattaatcctccctcatcattaaaaaacactgctccattttgtaaatagcagcacagagcaaccacactggagaagtcatgcttaacaatacattcatttgtgggctttgtgatttttttccctctcaagccattttgaagaaaatctttgaacacgtctcagtggcttgatgcttcacattaagctcctttaagcagctagaagtttcctgaaggaaacacatgagccttttactcctagaacgccaagagctggtggagtcctcaagaaaaaaacgacgattccagtgggaatgaatttccttctgagaagtgaagggcaaaccacattgaaaaagttgagcttcatgcctcaactcagaaagttaacctagccagggtccaggcaagaacaaaatctgccagaaaggcagggtgagctcagacagatttcaagcaggagcacaggcaaggtaatgttcaaaatcctgtccagcccccaggtactatgaatactcaatgacatcaaatggagccagttccaaattgctaaacttgtagctcatagctgggtctcctcaagaacttgtctttagacccctaaagacacctctgccacatgaagagacccgaaacgcagcttacatccagagcaagtcctttgttaatgaaaatgtgaatggcaaagacatcaaggtctctagcagtggccatatttgaacatgttttaggactttcagataaaatccgattaaaacaaacagattggggccaggcacggtggctcacgcctgtaatcccagcattttgggaggccgaggtgggcagatcacaaggtcaagagatcgagaccatcctggtcaacatggtgaaaccctgtctctactaaaaatacaaaaattagctaggcgtggtggtgcgcaccctgtagtcattctttgcagttccttgctctggggctgcatgaaggacttccacctgtgaaaagaagtggcgaatctggggcccatcattggaaatgccagccttctcactgagtctgctattttgcaagaaaaatcaccaacagcattccccttaagtaagtctctcgagatatcacccaaggcagggaatccccaactttgctcttggatcaagaagggcccccgataaggttttcaatcatccttagaaaaataggaggaaagcggaagaacagtactcttaggcgaaattaacataactgaagtcacattcttttgaaactatgtcctcagatttttgggggtggaggttaaagtgtcctttatttgctgaaatgctgatgaaattagagaatagaggttttcctcctttgttaatgccttcacgtattggcatcttgatttcctccttttaaaaaatgtactagttttggccgggcgcggtggctcacgcctgtaatcccagcccttcagggggccgaggcgggcggatcatgaggtcaggagttcgagaccatcctggctaacacggtgaaaccccgtctctactaaaaataaaaaaaaaaaaattagctgggcatggtagcgggcgcctgtggttcccagctattcgggaggctgaggcaggagaatggcgtgaacccgggaggcggagcttgcagtgagccgagatcgcaccactgcactccagcctgggcgacagagcgagactccgtcaaaaaaaaaaaaaaaaaagtactagttttatgtcttaatagcaaatctccattctaaaatgtctacaaaattatgagaattttattatatacatgaaaacatctattatggaataaataggagaaaatgtaaaatattatgtacagtatgattacaataagaaaaaataatacacaaatgtaaaatgaagatagttacacaagggtggtataattgaggcaattttgagtttttaaataattgtttaatgtccttaaagcattactttttaattaaaagaaatttcatgtgaatgttattataacagatttataatagactttttaaattacctaccaaagcataaacatttatctctacagatattacagtatgcctttccaaaaatagtcaaataaatgttagctcttctattaccagtataatgtgtacattgttagtattactgattgtgtcctgtctaagtacgaactcaactggcatatccacattaggtcctgaagaatggcctcagccttactcaaggaccgttctctgataatgtcagcttgaatagaagcaacttaaaaatctccatgcaatttctattagcctcactcatgctgctgcaagatctacaagccatttgctcttgttgggagtgtgaaatgttaaccagaaagtgtacttattatagggcgtattatttcttttcttgcttgcttctttctaactgaagattctgctctcgttccccttaaaacaatcttcagtgtttcctagatgaaatatttttctccatctgtcctctcttccagcttccacacagttgtagacttactctcttgctgaattttcagtttttcctaccaaaataccggctatttttgttctctccttccccacttctgtccactttttaaaccatcaaaaagctatctatactaccccaaatgctttcaacaccaataatacaaaattatattaaaaatgtgatcttggagtggcacagtaaccattgtcacggggtcacaaaaatcactgtttttaaaaaatggtttccctcactgaatgcccatgctgttcctggacttcactagaagtacaataaataatcttcataaagaacagtctgaaatcaccacatggtagactcgcctgagacaatcaggccttattccaattacaagcacgttgaaatgctagagaaaatctaaccaccaccaacatccaccctgcccccaagaaagaatttacatacattacacacatggccaagaacaagagaaagaaaacagaaagccccaaggtccagagtcaaagaaagaaattcagttagcaagtgctagctgaatccacaggaacccatagggatttgggtcacaagtgcaagtcctaagcactgcgggtggggttccaaggcccaagcagggacaaaggacacagcttatgacccaagagaagcaggagagcaaagactggaacctttcctagcaaaagtagctgtgtgcctaaggctacgtgcagcaaaaacagtcatctgtgagaaataaaaaccacatttctgttacttgtatggtgtgttgcagcccagatagatgatagatagatgatagaaagatagatagataatagctagatagataaatgatagatagataatagataaataatagatagatagataggagataggtacgtaggtaaataggtagatgattgatagaagtaggtaggtagataggtaggtaggtactagatacatagatgattgataagtaggtcattagacagatgattgatagatgataaatgataaatgattgataaatgatagagagagagatgatagctaggtagataaatgattgatagaagataggtagataggtagatagatagataaatgattgatggaagacaggaaagtaggtaggtaagtagactgatgactgatagatagtagataggtagatagatgatacacagaagataggcagatagataattgatagaagataggtaggtagataggtgactgatagatgattagatgtatagatagatggttgatagaaagatgatagacagatagatagataaactgattcatgaccaactgattcaacacccctagggctctggcagaagcaaaaataaaactactttatagagacactttcatagcttacattatagagaattcacaaagaaagaacaatcctcactgaagataagctcacaagaaaattttgtaaagtacatgaagaaaaaaaccaaaataagtagattttagtagatgtagtagatacaaaaagattgaggattagcaccccaaacagcatggataaaagatcaaacaaaagcatctataaagttaatttaaaatgactttttaaaaacagaaatttaaaccataataaaaagcagcagagtataaatcaataacagacagagctgaaataactgaagacaaattccagaaataaaaatttaatagactatcttaaaattagttattcaaaaatggtaagagaaattactgaactacctagaaagaaggaaaaacagagatgttaaggagtgtggaggctagcatgagatgtccaagtgaacagtgaaaatgagggataaaaattattcagaagatatatttggagataaataataaccagattttagagaaagaaatgagacttcagatttttttttaaaaaaggagtcctgagcaaaataaacataattaaatccacatctagtcatatcatgataaaacatcaaagacaaagacaaagtattaaaagtgaccagagaatagaataaagattatctacaaaggaaacaacctgatggatacaagatttctcatcagcaacaacagacgccagaagggaataaaataatgccttcaaagtgctgctggaaaataactggcaacctaaaattctacgtcaggcaaaactaacattcaagagtgagtataaattgaagaaatgttgagggaaagaccaaaagattttactacttacagacacttaattaaagagctattagagtatatcttcaataagaagaaaattaaacccagaaaggaaaaaaatgaaattcaaaatacaaaggtaaacaggctgggcgtggtggctcacgcctgtaatcccagcgcctcctgaggcagtcggatcatgaggtcagaagatcgagaccatcctggccaacatggtgaaaccccgtctctactaaaaatacaaaaaattagccgggcatggtggcgggcacctgtagtcccagctactcctgagaggctgaggcaggagaatggcatgaacccgggaggctgagcttgcagtgagcccagattgcgctgcaccactgcactccagcctgggcgacagagccagactccgtctcaaaaaaaaaatacaaaggtaaacaaagacaattatgagtggatatatatgcatcttaaattcaattttaaaagaaaattatgagttgataaatcaagataagcattgatacaattaaagagataatagtaatgattaactttagaaatcattactaaaacaaagcagaactaaagaactaggtaacagtaacctgagagctggaagtaggggagcagagtcagagggccttggatcgtttggaaagtgggtagaaacaatgcttgatgtcagactttgttaggtgagggataattagacaatcgtaagaagagtctaaccagactaaaattagagtgtataacattcccaaaacaggagattgggataggcagcataaataaatttgataaagtcaggaaaaatgaaagtcacaaaataagttgacagtaacaactacaaatatattttgtatatattgtaatttacacaatatataaattaatctcacttgtcaaaacataaatattctcagcctggatgatttttaaaaatccagttatactctgtttatgagagatgtatctaaaccataaataaacagaaaagtttaacatacatttactgaaaaagatatacctgatataacataccaaaaaagaagttcagctatcaacaaaaagaaagctggaatagccactttactatcaggacaagttagactttaggataaaattatttattagggataaagatgagcaaagcttggtaataaggagcaataattcatcaagaagatataaaactccagaagctgtgggcaccaaacaacacagcctcaaaatacatatgcaaaaatcaacagaattataaacagaaatagaaaatccttcattatagagagaggttgtcgctctcacctaaacagctagattaagtagacaagcaattagtacaatgattctcagaggatgctttgtgagacttcacctgttgcctgacatttagtggccaggacctaaagctgagggtttggaggtgtctgggaccccacattctgaattgtctgaaagaaaagtcagacaatttctttcaccctctatgcaccccacatacaggggcaccagaaccagtggggtgggagcaaaggggtgggtacaaacaatggaacagacctcaccctccagattcccacagcccatcccccatgtcttgggaggcggtttagggaggaagaagggtagaatcacgtaagatcttccatgggttttaaaattgcatatatttattgaaagtatacaacaggatgttttgaaatactcatctggatatacatagacacagcacaatgattactacacagtgatactacagtcaaacagattaacatacccatcatctcccattgtcagtgtctttcttggggacaaggggatggtaaaagaacctacaatccatgtaagagattttattagaccagatcagacttttaagtgattaaaggagactggaaagctcttgaatctactccagacagtaacaagggatgtaaaagagagatctgtccaaacgtggatgaaggcaaaggggaagaaaatttgctgaatgcaccacttatacaaagatctgaaaacacaacaatccagctagatctagcaggcattaagggaacctgaaccaaactgaaaatacatactattttcacgcccatgtggaagatttctaaaaacgacatagtaaatcccaaagaaagtatccacaaatttcaaagaatgaagatccacacaacacgctccctcaccacaataactcgacactggaaaaaaacaaaggtatctcaaaaaaaaagacttaaacttaaaaaaataaaaacaattatgaggcaatcaaagaaaattatgaaagaactaaaccaccacaaaaatcagtacgtgaactcaatctacttgtattcatatggataatctcaacaacataaccttgaatgaaaaaaccacttgcaaaaggatatgtatagaataacaccatatgtgcaaaattataaacacatttatagaatacacatgtgtgcaggtgcacatgcatatgtgtgaaatctgtgctgtatacaggcaaagagaaagcagagtcacgtgaacaggaagaaaacacacccatttctggataccaaatggaagaggaagagactgggcaagaaaaggatcaaatgaatcatgcactctgtttgtaagctgtgtttcttcaaaaagactcagaagacaatacaaccaagcattagcgtgtgttgaatttggtcaaaggcgtttttcgttttattatgactggacttttgtatatttcaaataaatagaattaaaggagaaaagttacttaaatgctccaagccatttttaacacggcttctgctcctctgagcacctggctggtgcctttagagtggcgagagatgagaggccacaagggaaggatggagggagattcaggttcacaggttctttgcaatttaacatagcaacgctgcgatcactattcaaacacacagcaagtaatggatggcacttaatatgcacttcggtttcttccactgcccttgtgcaaagtaaggcttcccagaaaacaataagaactaaaatgttttcctgaaacaatgctagattcctaaaagcaatacccaagcttgagccataatgggttcaagggtggtggatgaaacacatcttcaaggttactgttagttcactgccatgcgggcttctatgcaaacggcaacattcaccatccaagaaagtaaagagcccagactcagtctccctcttccacagatcaactgggcccaaatccatccacttctctgcattcagctctttcattagtaaacctgatactagtagtccacgtgcgcgcacgcgcgtgtgtgtgtgtgtgtgtgtgtgtttagcaagaggggcttgaattcctcaaagtctcaatgaaaactcagtgtagactgaagcaggggagattgaactgcaattgtaccagtgcttaaagacaatgaatgtttgatctgagcaatcattctgtgctgtggtgtgagaaaggaaacctacggagtaatacccctccttcctgtgaccacatgggctggactgtgcatcttggccacctctaatgcaatgcaacaccaacccacgctgtgtctctctctgtccttggcgaggtcctacacacaatgcaaggaactgcttcaccgcactggccaaggacaacaagaataggcttgaggggagattgaaaaagaggaagaaagtgtttcacacagaggagaaaagaagttttagattaaaagagccctcatcacttcccatgtgctctcaccataactgccttggagggaagcaatccctgctatccacaaaccagcaggactggcagaaggtggaacacagaggtaatcccttccaggggctcagacccaacacaagggcttcacccttggctcacttcttctcctcgtgccacgcatccaaaccctatgcagaataacacgcatgccctcatcaccgcccacctccccacctccactgcaacgtccctggtccaggccactgtcacccctcaactggattattatgttagcttcccatgttccctgcttcaaaccttgaaactactgtccacaaggcaaccagcaagatctcccgaaaacatccatcagatcacatcactcccgctgctcacaacccgccaatgctgggcttcccatcacacagacccacggcccttagggaacctggcagcaccccttcatcacgtggcccctctttctgtgacctcatctccactcctcccctctctccatctggccgccctgacctccctgctgctcctcaagctcagaaggcaactggcaaggcaactggctgttccatgtgtctggaatgttcttccccagatagctcccggctcccccttcgcctcccacaggccctcactccagtgtcagtctttccatgactgtcactctataaaatcctaacccccaacactctccatttgctgcctctgcctcatttttctctccttagcatttatttccaccacagcaggcctttgctcatttgtcttattgtctgtctgtctcctgcctgaggatggggacattcatctgtttggctccccgctgcatcctcggcacccaggacaggggtgggcacggagtgggcaggcaataggtgtttgttaatggaattctaaaagtaaatgacaaaagagaagggaggtgaaggcagatctttgttttctggtttataaacttagtgctgggcaggaggaaaaaaagcggggggttcatgtgaagctcctttcctgagtcaacatggtgatttaaaataaactaaatttagttggagaccttttaaatcatttttctcaagtcagttatatgtgctctagctcataaataggaggaagaatgcgggtgacattcccaagactgcagcaaatgtcggccaagtgaaaaacacacagaatgtcctgaagatccagcgacgtcctgaatgtgacgcgttccagttcacaaaagaggagtcacaaaatgtttacaaacctttaccatcccattgaaatggaccttcacattttcctcaaaaatagctttctaaaactgttactggtttacattaattttacctttcttctttttttcccctttttctttcttattttagaaataaagtaataggattagctttttgattaaagcatattaataaaattttgacattttatttgatttcaaaacatgttccagtttccatcattatagtgggtcctgtatgccatgtttatgttttgaaaggctgaaattatgtgtgatcaacaaatttattttatatcaagagcatctgtacatattaaatcctaaatgtgtcttgaaaaataccccctcacctttctctatcctgcattttatctgaagcattgtaagtcttcatgaaaaacagaggaaaaaatgaaacacagtaactaactaggaaccattagaattattttctttgacatttcctttttttttttttttttggagacagagtctcgctctgtcacgcaggctggagtgcagtggtgcaatctcggctcactgcaacctccgcctcctgggttcaggcgattctcctgcctcagcctcccaagtagctgggactacaggcgcctgccaccatgcctggctaattttgtatttttagtagagatggggtttcaccgtgttagccagaatggtctcgatctcctgacctcgtgatccacccaccttggcctcccaaagtgctgggattacaggcacaagccaccatgcccggccctttctttgacatttctaagcagtagatatttgcaaaccatgttaacgatctgtagatgtatattactaacaggcggggcccattgaaatcctaactcttctccatttgtttgctgattcttatcagtttaaataaaatgttcactcttaaactacattttaagcaccgcataggaagaaggtgttcatctgaggaagcagtgaacggacatcataaacttagtcaagactgtttagtaaaatcacaaatagaccaagcagtttcactgctgtgagtttaaaaaaagaaatcactgatctttagtcagacatagttttctgaacgaaagttagcacacgcggcccctttccagtctacagttgacatgtgtcttctaagtgactagactatgaaacctctaacactctcatcagagttaattcagagctagtcactaaagcacgccccctgaccacatcgtaactactgtgaaaagcagtccttatagaaatcatgacgttcttttcctttgtttgcagtaggttgttcatcgttttcatgagaacataagggccctctcccaaatagctcagtccccaaaatgcagacatcagcaaatgacagcaggtaacgcctgcagactggtgctcgccgctcactgtgaaggcaagcaggcttctgcctcagttttttccccctttctcctctgatccattccaatcaacaccactgacagtggacagactgctgtccgggtaagagtgagggggacagagggcctgaagttgctccattcgtcctcatcacgatgggtaaagaagggacttcatgtccatgtgcagttagcttccaaaagacaaggaaatctcccacctagaaggggacccccccaataccaaccacaggctgggccccccctcttcagccggcccctgcccaggtcctgctgaccaagcctcctcaggacacaaggtcagttcaggacttcagtggcctcatcccttgcatcccaccttctgagttaaagtctttcagaaatacagcaccatgggcttctagagctgcatggaaccctggagatcatcccactccactcgttgaacagtgggggaagccaaggttcagcaaacgggattcttccctcaggcttcatatgcaatggaagggcaccagctaaaagctaagcgctttgactcagagccaaagaccagggacctttctagcaccttcctcctacatataacttatatgtaggagaaacagttgtttccatgagcccatagaagaaatgtgatgtcaaagtatgggagaacgttggatagcattaatgtctagtcaatacacattctccccttgttcttacaatgaatcccaatgttgttcagggccacaatatcttcaggtacaaattacattcccaggcttccttataagatgtggccatgagagggagttgtggcctaggagatgtatgtagacatctactctgggtttctgggaaatcctgccctgctcttcctcttagggacaccctcctacctcttccatccttgggaccacgcagatgaaaccacctgcaaagttggcaggcagtggctagaaggcgactgggatggatgaatggcttccttgagcagccaccctgggaccatgcagatgaaactacctgcaaaggtggcaggcagtggctagaaggggactgggttggggacgaacggcttccttgagccctggactggtccatgattgctcaagtccaggtctctccttaggcaagacaaacacacatgtggggaggaaggccaatttatctgatcggtgagttgggaagaaaagacacagcatggtcagcgtggcctcagcagggagtccctcctttggggaaatatcctgtcccaaggccaaggtattattctggttggccattggatgagattcctgggacaggctctccctctgggggaagcccaagattgtccggctctactcagcacaaatgtgtaagtgtgtatcagaggtgaagtatcagaagtcttaggtatttaattattattaaggcaaagattacatcactgcctgagatacccaaatcccatcccaagcaatttcctaacaactgatctcataataataacaatcttattatgaaaaggccagtgcaaattgattcttagagacactattattcagtacaacaagaatcagaaagtcaccataaaaccatggatgtccagttaattcctcaccttactaaagcaaataaactgcctttagaattaaactggcaataccagtgctgccctcaaaactcactgctgcctcaccaatagataaaatgtcacatgagatgatataaaataaatggggagatgcggaattacctcactgaataaaatggttatctgaacaaaatgtcatgtgaactgacttgtcatggagcctaaaatttcttgagtcccattcccttaggtgaaggtgggaaggcatctcaaaaaatgcaagcatggggctttgaaaaagtcttcaagtaaaggaggcagtaaagcaaaaagggtagaatcatgagctttcttcagttcagagttagttctggttctggctctgacatgtactagttttgtgacctttttctaattagtagacaccatctcagaggtagctataaagattttgagatgaagtctgtaaagcatctagtatgtagaagcatagaataaatgatagctgacaattattagagtgattattatttagagtgtctggcagtggtgtgctgacaaaagggtttttgaaaaatcatttgtttggggaggaagccctggtttgtactgactgccaatttccatggtgtgaacacttccattacagtcaacttcaagctaccaatgggatgtcactgaatgcagagttgagaagagatgcatacagtcagctctcaggagctgccaagagtcagcaacagcttctctctggttcaggcactgtagtcacacctattgacatggtttggttctgtgtccccacccaaatctcatctcaatttgtaatccccacgtgtcaagggagggacctgtaaaccccacgtgtcaagaaagggaggtgattagatcatgggggcagttcccccatgctgttctcatgatagtaagttctcatgagatcagatgattttatatgtttgacagttcctccttcacacactctcctctctcctgccgccttgtgaagaaggtgcctgcttccccttccaccatgattgtaagtttcctgaggcctccccagccatgcatagctgtgagtcaattaaacctctttcctttataaattacacagtcttgggtatttctttataggagcatgagaatggactaatatacccgtcttgatcattgggattcctctgtgtacggcaaagcacctagtgaatgaatgatttatgaatgatgggttattattaacacacaaagctatttttgtctcaataattttgcatacctttgaactgagactcagaaaaaaatgttttcatgaataagaatagataagagggacattagagcatggactgttgcttatacttgaccatgaacaccgagacagtgccttcccaacacctagcactattccaggtataagatatatggcctgtaaatgacttctggtttggactggactggactgaactggactggactggattggattggattggacaaggatgcagaaagaaactgaccataagtctgctcagaaaacattcaacctctaagagggagggaagtctaccctcccccacctcatttttatcctaagcactgcctggaggaaatgccctccaagtcccatggtggaaaccatctaagatgccccttcgtccatggggcttgctctttattttaaatacagttcagttttgattgctgaaattttcttggagccaagggattccaacaatgctactactcagaacatcaagaaattccctggagattcccaaagtaaataatgtgatataactcttacctacaattaatctatgcatgaaaatatattgagggatatgacatcttctaaaattacctgcctgaatttctagcagagagacctagggagttacatcatatgctgcctctccaaacccaacctctgaatgacctccacgaagggataacataataatgcggctgtgtcttggtaaatgtcatttattccctcatgaattttgacagagatgacatcaagtttcttccaattctaagatttgatggcaccataaatatgacttcaatttttaacaatttaatgaaaaaatccttctggaaagagctgctcatggggaaacacacctcaggcatgaggcacattttcttttccagcccttcctccaaccataacagatccaaaatggacttccaggaggatcctgaaatgagcccatgtgttcagcctctcccttaaccacatggaaagggcaggcggatgacctgcccaaggttgggaattcttcacacactaaagtccatcactgacatttaggagaacattttgtttaataaatgcaaaatgttctttaaaattatatccatgctttcattgtcaagggtcttaatggatgtgtttaaagcataaataaatatagtaggcattctgcttgcttaacctttcttcctcaccccttcatctcttcatataacattcactgaacataaaacaggacaagtcctgaactcatttctattccaagtactaactcaagtcactggaaaggtttctatttcatttagatggtacagagatgtcctgctgtttctgtaccatccccatcccattgttgatatttgatatgtcatgttcatatctgttgtctttgtttcccaaagggtttgtttagagtccactgctgaagaagaactaaatggaatctgtctctgggcaggaaggtagggaaggcctttgttttcccccacagtggcaccgacccagacaacagatgacagaaggaagagaccacaggcaggacaaggccagcctggagcagcacctggcaggacgaggcttaaaagaatgaataaggggtaggcccaagcccacacgtgtcatggagtaccatttacaactttgcccacttgacaatgggaatggggagagcagagccttccagaccatcaacagtaggatcagaaagtagaagagtctggaaaagcaagactaagccagaataatctggaagaatgcagccccagtgagaagttgacagccaagcaaggagcaagaccatcctgttaagaggcactgagtggtgaaaacagccttgtcatgaaacagggcagatgatcatctcggaacgaacaggtgcattcaggaaagataaaaatgaaaacaggaagatcaggatcattaaccggtaaaacaatgcatgcccctaaaataacaactgacaaggataaagtggcacagagtgagaatcacaaagtaacgtggagcagattgactctaatagaccttttctggccccaaaagcaaaaggtttggttggtgacatcttaagacaccttaactataaggtccctaagtggacaagagcaggcaagctctctcatttggcggggaggttgggggggaacaactttaaaacagaacttaacaaaatggctaatactaactccttgagaataggattcttctagagaaaggcaatggtttgtaggtaatgtagccattctgtcaatagcatcagcaacagcactgcctcctttacaacacagacctctcagcatcaccctctgtggggcaggagacagagtgagcagaggttagtcacatccatgtgggttctagctcccctctaccactcactagcagtgtgacattgctcaagtgacaactttgtgcctctgtttcatcaactatcaaatgagaataaaattagacttacccaccagggttgctaggaaaactaagcgttaaagggcagaacccaatcctgaaaatttagcaagtactcaataagtcaaagttagtccctggataaggacctgaaacatgaagtagatgcaattcaaccagggtcatgcaaagccgggttcagtgggaagaccactgagtctgtcagacacctcacattaagccaacagtcattgtgacctaccaccatccacttccctgacttctccaagatggtgtcaatgacacactctacctgtagaccgacttccttccccatgctccagccagtccagatactaagctgaatgtacttcagagcttcagcttcataagtcaatggagtctagaattacagcccacacacctggtatccagagagccagagaagagccttgggcacatatttctccaagacatgggatgtgtttctctgagacatttcctcatcctcctcctctctattcctcttgctccctcccctcatcctcctcctctctattcctcttactccctcccctgtctcttccctcctgctcccccatttaatctcactgtgatcctagcctgcttcactctctggccttgcagctaattaaaactgtggcccttagtcatttatttaaagaccccaaaaaaatggcacaggagatctagcaatcataaaagcatcacttttctgagattctaacagggatagctcaggaggccctacacaatgtattggtgaatctattctatttcagcctaccttgcctgacactgtttatagggccagaatttattaccagccttacggcttcataaattagctagtcagctattgccacacctcagtatactgtcacatctgtgaatttatggcattgtggcttaatgtagcatcattgtcatcactttccagtacctggagcattcattttatcctggaagataattcgtcatggttattatgagaataccaacataaacaaaagaggaagaaaacatgtaggttatggtctaattgcctgaatcaatcccagaagaaaagaagatacttgacaaagtctgcagtctttgaatgaatcttgaatgtgcttagtattattcagactcgaaatgctttgcacacttgaatgggaaagtatgcagtgaaaatcccattgaaacgccacagaacgccagccaagctaaagtgctgcacttggttggaatatctgggctctgactcctccgtaaatcaacatttaaagtgttagatacagagagtccataaatcattattgcatttcttcagcataagctagtgccttcagcaagtgtcttctgctgtttggctctttgttctgatctggtttgatatggctggtgtgggtttggtttggttcgtttgtggggatgaagaggttatgcaacagaaaggcgatgacttattcttttgctcttgctcacatctcccaggacgtaaaaacaatgccaattcaaccctcctactcatgtatgacggccaaacctgacttctggcttctaactgcaaaatccccagcacactctgcaggcccgcagccagctcgtctgcttaggaaggagcaatagtgtaatttgaacatgaccaataaaaaagaacaatggtcttacttacttttacaggttacattgtctcacaggtaaggaatggaatttttaatacatttaaaaatagagattcctaaccaataaaatatccccatcaccaagattttaaggatgccatgagtagctggtattatcaatgacatttgtgtagtgggaaaagcatggattttggagaaagaaagatgcaggcctaaacgtggactctatcattcactattgcccaaggacaggctttctctccaccaggctaaatcaagtttcccagtacacaagtgtggtggggagcagagtggttccgcagcagcaggctggtaaatttagtcctaaaacaagacaggtctaaaaatcttggaaagtagaatctgtttggaagctccttctagacattctgtcaagcacagccttgttcagtaagaaggaccttagacatactttactcatggcttcccagaaaaaaagtgaaggatgatgccatcagttttcagcatttattgagagaactcgaactactggaggatttcaaagatgcttattgggtatccaagtaagacgtcaagtaaaattttggatacaggaatttgagtgtgaagggaagcccaggaatgcaactatctgggagtcatcggtgtaggtgggattggaagccatgggatgggatgagatcacttaggaagcaacagactacccccttctgtgataaataaattccagcagattagtgtagattattgtccccaactcttatgtcctacctcctttcatgcagctccacatgtcatcttgtgacttgtgcttgcctggcagtagagagcgcactttcctctccaggaaccttgggcttggccaggtgtcttgctttgaccagtaaaagtgagcaaaagtgaaagtgtgtccgttccaggtggcaacttgaagaggaatcatgcatttctgcttgccccttgccatctccccgctgccatgagagcagcatgcctcagagagctgctgtcccttcaacctgggacccagaataaaagacacagggacctccattaggcccagctgagtccgacagagctccagggacctgaagtcctctgagtgacaaacaagtggttgctgttacaaattactgagacttttggaggccatcatttgctactgcagcaaaagctgactaatacaaaaataaaacccatctcttctggcagatccccccagaaaggagggttagtctccctcatagatatcaggccaccaagcctaagagagttccagatggctatgcaagttcagcccaaggcaatatacaaaaatgctccgagtttaccactggaatttccagagtctacttagatgctcccctgagtccccactcatgcctttccagcaatgaaaacctgctccgaagaaaaaatggctgacatcgagatgactctgagtacacaaggtgcgaagttacaggagacagaggctctctcggatctccaggtaaacacacgcagctgctcaggaaggcagcctgatccaggagcctgcaggagcctgagtcctacccagatggtcaggtgcagccccagctgtcccaggacatgcacgggaggaaaggtgaccacgtgctgtcagatagcagctcaggcaccactgtgcagtgcacaaccacacaggccttcattcagcaggggactagatttgtactctttttagccaaatgtgggccttctcatgctccacgtgtaaacgtaactcaccaaacagggcccctgctgctttccgggccaagtcagtggagaggactgaaggccggctcacagctaggaaagcagggctctgccgcgccgagggaatgggtcccaggtctctttcaacatcagtaggtaacacacacactcacagcacacaccacacaccacacacactacatgctcatacatatcacacacacacacacaccccccacacatgacatacacaccacaccatacacatacatgccacacacacatgctcatacataccacacacaccacacacacaccacacatcacatacacaccataccacgcacatacacaccacgcacacatgctcatatgtaccacacacaccacacacaatcacacacacacgtcacatacacaccatatcacacacatacacatcacacgtcacatacacaccacacattacatacacaccataccacacacatacacaccacacacaccacatgctcataaataccacaccacacacaccacatgctcatacataccacacacaccacacacacatcacatacacaccataccacaaacacacacaatcacatatacaccacacatacacaccatgtgctcatacattccacacacccacaccacacatactacatgatcatatataccacacacaccatacatacaccacatgctcagccataccacaccacacacacacacacacacacacatcagcacacacacacgtcacacacattttacatacacaccacacacacacaaagcatgcacacaccacacacaccacatacacacaagaccacacacacacatcatacataaaccccacatacacaccacacacattatatatgcaccatacactcacacgcacatcatgcacacacaccacacacatcacatatacatgccacacacacacacattacatacacactaaatacacaccacatgctcataaataacacacatcacacacacacagacaccatgcatacacaccacagagcacacacataacccacacacatcacatactcaacactccacccacacaccacacaccacatacgcaccacacacacacacacacacacactgcacacacaatacacatacacataaaatttgcatgaaataaacataaaggaaatgaacaccaagattcatctctcttgccctgcatattggattgaaacatggagcagactggccaaatttaagatttttataatttacctctgaaatcttcatcaaattcaaaacacaatttcactttttgccccatccggcagtgttgggggttttgccactggaataacacagtatattttccagtcacaccgtacatcagagctcatgtgtgtgttagtttgttgcaggcgtcctggtagcagagcgtgaggtcctagactcagagtgagttcctccctccagaaatgaaacacctaagttgctcagcactgacagcaaacatgtaagtaaggcaaaggttgccaccagcccagcaggggtcgaacttaaaatgaatctgtgcatgtgggccccttgcctttgacccatggggagcatcattccataaataaacaaggcaatacctaacagccattagatttcttcaaggccatctctgcaatttctttgatgaaacaaaattgaagttcataatttcctcccaagctaatgttttacaataatttttttaaagatcccagagttacagtaatcacatatcaaataagaacattcctgagatgttttccatttggaatagtgaaattatttattaaagcatctcggccttcatccttcaggctatatgtgaagccttcaagaaaacctcctcgtgagcctaaccacatgacttggcagcccccactcctactttctagatcatccctggccatgctccaccacccatcccatgatccagcctcggcaaagccctggctgtctccacattacaccaagcacctggctgcatgctctggcatacgccacttaaactctcctccctgggaacatcacatactggggcctgtcgggggtgggtgggggacaaggggagggagagcattaggacaaatacctaatgcatgcagggcttaaaaccgagatgacggggtgataggtacagcaaaccaccatggcacatgtatacctatgtaacaaacctgcacattctgcacatgcatcccagaacttaaagtaaaacaaaaaataaaaaaactctcctccctactcatcccggcgaactcctgcctgccccttagacacagttcatgcaccagctctgctgggagacaccccttctgtggtctccatagagctcctgtccacctccgttcacagcgtagggctgggaaaaaggttctgtgatgggacgacctggatttgaatctcagcaccgctcactggctatatgaccttggacacttaaccttcctgtatctcaatgttcttgtctgtaaaactgggataatataagcactcacttgaggcaaatgtggtagggaatagatattttaataaatgtaaagcacctagaataatacttgaaacatcacagcccttatcacaatgtattaaagttttctgtttatgtggctatctcccccactagactataagcattttaaaaagaatatgccttattattttaatatccccagtatttagcaaataacctggcacatagaaaattttttgttcagaatgttgaatgaatgaataaatgtatgaaattaaaaatatatattaatattaaattcctgctatcctgtcccaaaagacaatgtgctgtcatcactgcttgaggaagaagtacattatttcacacatcaacccaccttcatcctttgagaatttttttttagagcagaaatagactctatccaaaccatatggcataaagctgtagtttttaaagataaaggtacacttcaaaaaagtgctgactcatttcatccttagatacagaatactcatcttcagcattacaggcttgtgatggaagaatacaaaattttaaaaatatataaattcacctcttagaggtaaaggtttgaagaacagagttatttggtctacttgcaccattagtttgtttttttttaattttactttaaattttgggatacatgtgcagaacacgcaggtttgttaaacaggtattcattgtaccattagtttttaagaatccttgatctttaaaatgctacccacttggcctcctcttttattcatggccttgttctccaggagagaggctgaaacatcccttagggaacattttctgtcaaggtgctagaccaggagtgtgaagcagcgagccttaaattgcaggaagccacaacagcagaaggcagaacgctcctcaaacttgaacgcagagcctggtgctgcttccaggaagtcccaagccagcctgacttctgacagttgatctcaagatctcaacctatattcattttcacatcaagactttatttttgaacaggttccaggatacaacaccagcttttttattgaaggcaaagcattctcaattacttagatacttactaattaatatgattggcgatatggtgcgtatttagaataatctgagatgaaactcattgaagcagctttaaaaagcccattacaataaaaataatacttgaagctctttttttttttttttttttttttttgagaccaagcctcactctgttgcccaggctggagtgcagtggcgtgatctcggctcactacaacctctgcctcccagttcaagcgattctcctgcctcaaactcctgagtagctgggcctacaggcgcctgctaccatttccagctaatttttgtatttttagtagagacagggtttcactatgttggccaggctggtctcaaactcctgacctcaggtgatccagtcaccttggtctcccaaagtgctgggattacaggcgtgagccacgtttggccaacactcacttttcccaaaatgtcatgataataatattcagtgtggaaggactgaattctgagtcacctgcaaaccatgatacagtctgtagcagtggtactgagtgtaatccatagaccagtgccattttgcaaaatgttgactgaccatgatgagagaagtacggaaagtaagaagggcttgtaaaattttagagcaagttgacatcactgtgacatcagtatgagctcagtgctccagttcctctaaataaggtgccgaccacttcagacactgcagcattactcacatttgggcactcattggtagggccacattacaacatgtgaccttttaaggtcagtttgtcaaggataaatcaaattatatgaaaatctgagaaaagggaagcacttattttcataacttattttcataatctgagaaaagggaagcacgttatgaaaataattaaaatttaattaattaaatgtttatggctttttaaaatttatagtttaacattactggctaaataagggaagtcaaattagtattatgtatttataacctttattgattgattgatggcctctttttggtcagaaaaacatatatcttttttgaatgtgacaatcacagtaaccaaatgatgacaaagaagttgacattgaagaaatgaaagccaaaaaattttgtattcattttacttgaaagtataatccctcatatacaaatttttatagtttatgtagccataaactacagttttgcagccataattgatagcaaagtgctaaaaacactgtaggtcacttgaacaaatgtattggcaaacaaaacaatgaaactatcaaaacttgagtagcatttacataaaaaaattttttaaataccgagaataaaaaaaaatttgcaaaaaagagtattattaaaaagacaacaaaagtagatgttgaatatttcatgtctaaaaatgaatgtcttaaggcttcctgtaaagcagcacttacattactaaaaccaaaaacaaacaaaatgaacaatcaaacaaaaatcataaaattgccaagacattaatgtaaaactacattaaagaagtctacttggaaatgttcggtgaatctgtaacccaaaaaaaggaagcttgagtaccactttttaataatatcacaaatcagtgtttttaagaatgggctgatagcatagctgtaatgacaggaaaatactgtgaaatcattattcagataacaatgaaaataaatcaacaacctgcttcttttcttcagaaagtcttgccaggaggaaaaaaaaaatcagctgaacaacatgcttagagacatagtatataaaaactaatgcattaaattcaaggtttttacatttattatgtgatattatagaagatgaacataaagaaccgtagaagcatgcaaggcttgatggctgttatggggaaagattctgacaagaatgtttgaaatgggaaatgaactcttagcgttctggtaggaaacgagttttgtcccatgtttttaaagatgtgaattagacagccagactttcttatctgtctgacatcctcagtatttgaaaatatcttaatactcctatgcaagaaagggatgtggtaattttttgatgtatatctttatataaccatgcatagaagagtctgggaatatacaaaacaaaataataagagtggctaactctggagagaaatgacaaggagttttctcttcttttttttttttttgtgaaacagggttttgctctgtcatccaggttggagtctggagtgcagtggtgtgatcttggctcactgcagccccaacctcctgggctcatgcacacctcccacctcagcctcctgagtagctggggctacaggtgcatgccaccacagctggctaattgttgtatatttttgtagagacagggttttgcgatgttgcccaggctagtctcaaattcctgagctcacagaatccactcgcctcagcctctcagagtgctggaatcagaggtgtgagccaccatacacagcctgctttttctttcttttgcttctctgtatttatagttgtttttctaccctgaatgctgcctatgtcattagaaacaaagaccacagagtcataaaagggtcacacaagttcaaccatttaaaaaacattgtcaagagctttgcccatctaagggaccacatgagcattaatgactgatgggctccatacactacccagaatgactaacacatcaatgaaagacatgatgatctaaggaccgagggaggggtcgatctaaaacacaaaatgtccctgctcaatagccacctgcacacccacagctactgcgtggagaaaagagagagctggctgcagtccccctcctgggggaaactgtgaagcacaacagagacctgctgtctggaacctggtggctccctccccacagtgagcataccacacctgcactctcatgcccccacttctctcatggaacttccctgtcccttccctccagaagctacaagctctcagaatcacacctttcgtgctccagagtcaacaaggctgagtttgtggtgggcaacaaacagactaaatcttcacaccatttctcattaaaccatccctgttcatgagatctgcattaaaacttttttctcttttgtcaagagataaagcagcagtacacagctttagaggactagggcctccccagtaaccctttcctccaaacctttctaaacaaattatcattatcattggtgccgttatcagtatactagtactgttaaagccaagagatgacctgttttaggcaataacatttacaattcaatagcagagtttcctgcacagactgtactatttacagagtcctgcagcccctggacaagggaacacaggctcccagctgcctgcttgcagagttcccctgtgggaggcagtgagatggaaacacctggatgagaggccaggagacataagctcctccatccctggttctttctccagggaagtaaactaaggcagattgcccattctctctgctcctaaaccagaggcaattttaagtggcttccagcattgatacactaggtctctatgaaaggtgcaaacctttccacactcaatggattctcatcacaaccaaagcagcagggcagtgtattagttaaaatccattttagttgcaagtgacagaagataacattgattttttaaaaacaatggtggcttaaaaacaaacaacccaactcaaaaatgggcaaaggacatgaacagacatttctccaaagaccattctatggccaatgagcacatagaaaaatactcaacatcaatgagataccacttcacactcatgaggatggccagtagaaaaaaaatatatcaagtgttgttgaggatatggagaaattggaacccttgttccatgctggtgggagcatgaaatagtacagctgctgtggaaaacagtatgacagttcttaaaagattaaatatagaattaccatgtgatccagcaattatacttctgggtatatacacaaaagaatcaaaagcaggaattcacacagatacttgtacatcaatgttcataacagtattaatcacaataaacaaaatgtggaaacaacctattcatgatcaacagatgaacaggtaaacaaaatgtagtctatacatacacgggcatattactcagccttaaaaaagaaatgaaattataatccatgttacaaaatggatggcccttgaaaacattatgcaaagtgaagtaagtcagtcacaaaagaacaaatatcatatgactccacttacatgagctacctagattaggtaagttcacagggacagaaaggagaatccaggttaccaggggctatggaaagggggaagggggaattagtgttcaacaggtaaagagttttttgggggatgatgatttttaaagttctggaaatgatgtggtgatgcttgtacaatattgcaaatgtgctcgatacccctgaattatattcttaaaaatagataaatgataaaatttatattatgtatgttttaccacagtagatttcttgttaataatggtggcttaaaccataggaaaacaagcagataggcctggtatgattatcagggacccaggttccatccattcagccacctcaacacagggcttcctctttatgatccaacatggctgctccaactccagtcatcatctcagccatgcaacagggaggtgggaggaggaaggacaagggcactcctctacctggaagttcaaccttcccttgagggatactttctggaagtggcacacagtccttccattctattggtcagaacttggtcacatagttgcacatggcttcaagggaagctgggcaatgttgactttgttctgggcacccatcttttcagctaacattgaggaagaagagacaaacaagtactgaaaacaacaaccaatcctgcataagttgaaaatcaccttgagtgcaaatgttttttagcacaggactgcacacctttatgttttcctaggatcacagtcaaaaagaagaagctttaagaaatggttctgaggactttcttctttgttaagctcactttgcaacataagaggaattcagacctcatagggatgtgagctacatagttattcaccatataccctcaggaagaagtagagctaaactgagaagcactacaaagaaaaaataaatgaagaagaacaaaaatgaagataaagggtcactttcttaatgcctcatcctatgcattttgtagaatttgaaacccctggaatggaaagcataaagctctgacaatctgggctgcattcagccttggcagaaaccaggatgtgaccactggctcattcctaatgtttcaggtgggtaacaaatatttgctttttccggggagttgaccacacaccctcttccaattccttcaactcggactgcatcttgcccttgagaaaaaagatttggcaccttcagaacacaccattccccacacttcatttcccattaaggttgtcttggttaaaaatgttgcgggccaagtacatggtttcacatactcacatggttaagagagagaataggagttctatgagtcacagaaaatttggttgaaaaaaaaaggaatcaggaagaatcagtaacactaaacgcccacacgtctcgtctctttaaagcacattgggggaaattttgcttttagtggtaactgaacattctgttgctgctatatatgtcattttcagcagagatgaaataactaacagcctgggaagatttttatagccttcccgtcctttaagggatggcgtggtcccaattttgacctcccttttactactttcctttcctttggataaaatccatgtaatcctctgtaacactagaacatctctgcattactgtgtgcacacctgatttccgtaccgttttcacccctcattttggcagcaatctatgcataaaggcaaaaagttcccacacccctatcctgacctcttggtagccgtgaccctcatcccagctcaaccctcctggcatctcctctctcctgccaggtttgtggctcaagtcaggaagcacgtcagccctgagacctgcaaaccgaatcccacagacagttctagagggtgtgcttgactttggaaacccagtttaactggcttctgcttgaatcatcactccattaacatcatcattccagaaagtcgttgctcaaggtctaaagcacttgaaaccttcccttatatttaatatttattacccatcttgaaggaacggcatctgaggacatcctcccatcttgtaacatggctcccctaagaagggtataacatagtgattgcaaagcaggactctgtagccaaccatccagatgcaaattctgattccatcacttcgcctgaatataactttggataagctgactaacctttctttgcctctacattcttatctataaaatgggcacagtaaaagtgcatcctcattaaaaaaatggtctacaagcatatgaaaagatgctcaatgtcactaatcatcagaaaaatgcagattgaaaacacaaagagatgtcacctcacacccattaggatgaacactataattttttaaaaattaaaaacaagtgttggtcaggatgtagaggaggtagaacccttatgcactgttgatgggtgatagggtttggatctgtgtctccacccaagtctcaccttgaattgtaataatccccacgtgttgtggagggacccagtgggaggtaattgaatcatgagagcaggtctttcctgtgttgttctcgtgatagtgaataagtctcacgagatttgatagttttataaaggggagttcccctgcacatgctctctctctctcgcctgctgccatgtaagatgtgactttcctcctcctttgccttccaccatgattgtgaggcctccccagccatgtggaaccatgagtcaattaaacctctttcctttataaattacccagtcttgagtatgtctttattggcagcataaaaacagactaatacagtgggattgtaaaatggtgtagcccctctggaaaacagtatggagggtcctcaaaaattaaaaccagaaatgctgtgtggtccagaaatcccacttccgtgtccatatatccaaactaactgagatagatatttgcatacccacattcttggaaggactaatcacaatagccaagaagtagaagcaacccaaatgtccatggatggatgaataaatgaaatttagaatatacataccatggaatattattcagccttaaaaagtaagaaagtcctgtcccatgttacaacatgaatgaaccttgaggacattaagctaagaaataagccagccacaaaaaaaagataaatatggtatgattctagttatataatgtatctaagggagtgaaattcatggaaacagaaaatagaatgggttaccacaggctggagaaagtagggagaggggagttattgtttgctgagtgtagagtttcagatttgcaagatggaaaatttcttcagttttgtttcagaacaatgtgaaaatacttaacactactgaactctacacttaaatatgattaagatggtaactttcatgttatgcatttctttttaccataatagaaaaaaaatcatttaaaaagtgattcttcatagagcttttgtatggattatatcagttcatgtgtgtaaagcatacaacactggatggcacgagcgagcatttctcaaatgtcatcgttatcaacgaattcacataccctgctccatgctatatcagcacacatgaattattttatgtttggttgggtgcctttttatttgtttgtatggagttttgttttcttatttatttttgccttctcaattttctgtgttttctgaggcctgttttagaagctttacacatctattttttaattattccttaccaggatgaaaataaaaagtagaaaataaatgtctgagaaaaccatcatctgcatctccttcaatttcataagatacaatttgaagtgccgaattatttcatttgttttgggttttaaaggtccttctttttactgaatgagagggatgtagattggcagcagttgatatgaaaaaaaaaaaaatcaggttgtttccaaaggcagtgtgatgggctgccctaaagctgctgcctcaaaagaaccataaggttcagatcacaaaatataatggtctcagatttcctagggcctgttctgtatataattctctaagaagaacattgataaaaaataatacgtccacaaaaataaaaccaatatgataactctaaaatacatattgtaggaaatcaggttaaaataagtagttgtattttatctgcaaaagagaagtttaaggaaatactgctttgaaataaatgaagataagtcaaatattcattcatttattcagttctgaaattattcagccactattcactgtaagatttctaggtaccattctaggtgttcctagtccccattatgagcaaaagtcgccacttcactgtgttattcgaggagggaaaagtagatacgatgatggaggcatatttgaggtcgatatgagaaagttcacgctcacaaacacagctgtgcataacgggaatggctattttatgagggagtaagttccctgtccctgggaatatgcaggaggagaaaatgtgagcattaagaatgccaagaagaaacttctaactagaccccaaatatctggtgtagataacaatcaacctctcctccaaccaaaaactcttcgagtccagttttaaggcacatcaagtggagagaacatctgtattctcagggtgacttcaggacagaatgctaagaaaatcttcactactgacttccatgttgcctgcacgaagacccaatattccattgtttttaacacagacctataatgaatctgtaacacttattctattaaaaatagtcagctccctttgcatggatgcagattgatgatccatttttagaatctcaataatgattacaatggcacagcatgtcacctggaaggtatactgtagaatccttgcctacagggtttcactgaagctttgaaaagaacatgaagataactgctaaaacttggaagcaaccaaggttccttatataggtgaatggataaacaaagtgtggcacatcaagacaatggaatattatttagcaatgaaaggaaatgagccgccaaaccacgaaaaaacacggaggaatcctgagtgcatattgctaagggaaaagtcaatatgaaaagcctacatactatatgactccaactacatgatattctagaaaaggagacagtaaaaagatcagtggtttctatgggttagtgaggaggaagagaaggatgaatagggagagcccggggcatttttagggcagtgaaacttttccatatggtactatcatagtaggatctgtttttaacatagacccatactgaatcctttctgaaaaatgtgagcctactataatagtatagcctactgtaatagtaggctcacatttgtcaaaacccataaaacatacaacaccaagagcaggccctaatgtaaactatagactttaggtgataatgatgtgccaacctagatttatcaattgtaacaaatataacacactaaaaagcaaaaacaatcaaactactctgagataccaaaaaacaccagatatatgcataaataaagaaatagtgagtaattcgataaatgaaaaagtaaccaagaggaaacttcacaggcatgattcctttaaggaaacaaagaaataagcataataataataaacttctcatttctaaaatccaaaaactgttacaaaaggattcaatgtgatatttttaaagcacaattattgagcataaaatacaatctggaaggcatataactttgcaataaccttttctgtgtttaggtaaggttgactgcagagttgagagctgggccattgacatttgaggtcatggtggcagcagtccgccactattaccacctatgtccaaacatagctgaccctagcatgactcaggttgaataatattcaggaaatgaggccttgggctagggtcccagctcttgcaatcactagttccacaatttgggggaggtgattcttctaggtctctattttcccatacaagatgatatggtttggctgtgtccccatccaaatctcatattgaattgtagttcccataatctccatgtgtcatgggagggaccagggcaggtaactgaatcatgggggtggtaccctcttgctgttctcaagatagtgagtgagttctcatgagatctaatgattttatctggggcttttccccctattgatcagcatttctccttcctgctgccatgtgaagaaggacatgtttgcttccccttctgccatgattgaaagtttcctgaggcctccccagccatgttggaactgtgagtcaattaaacgtctttccttcataaattacccattctcagttatgtacttataggagcctaagaatgaactaatacacaataaatgcacagaagaggtcagctagcagttttcacacccgtctccaggagaagagaagctaggaggagcaggagggcaaggagggtccggctcccaccaaaagagttcaccctctgggggaagggctacttattgggcttttatgcaaaattttatttgaacaaagaattcctcagctttaaaaatagtggcatctggttccttttccctgaaggtatttactcaagccaaggaatgaagcacctgtgggtgaagagcagatgaaagctggaactataaaagccggagggaagctttttctcatttctaaggagattatcaggaagaatgtactctggcccctggaaacccatccaacctctcctctcccacctgggctggctgcagcagctctgcaggatgtcacccaaaaagctccgttcccaaccctgcggcccacagcctgacaggaaaaagaactctctcaacctggattccggggccctgtactctaatagagggctggacactgcctggctgtccccctgcttagaaggaagcaaatgtttattcaaaaatatttattaggtaatacaacaaactgtcaaaaaggaagaggcgaacactgttacagtttacaaacatgaaccatggattcttaacaaatgggagactttaaatggggatggaaataaagccccaaggaggggaaagatgttgtggaaatgctgcccagtgggaggcaggcttggaaccgcacgctggtctggctggtgataatctagtctagatgaagatctggacagcatccttctgctcagccactagcctctctttgctttctagtcagtgtaaaaagcatctcaaaaccattgctttcccagacttcagtctcctgaaatgtgtgtgtgtgtgtgcatcccatatgtgtgtcattttgtgtttctgccagcctttctgttgaaacttgccagagaaaatgacccacctgcgaattggcaaacggaacctgactgaataaaaactccttgattcagagcttaagaaacaatccagtggatttcttactaatctgggtgttcaaaatagtctttctacttacttgggctcaatattttggaagctattgtggtgaaatgagtgatcacgttggaattagacactgtactactaattgtgtgtccttggaaagttacctaacatttctgagcttccatttcctcaacataaaatgaggataaaaatgtccatcatgcaagattgtcctgacaactgtgctactgtctacaggatcctaagaaagagcaactaaaattatgttaatgttattaattataattttaatcatcaatactgttaataataataaaagactttaaaataatttcctcgtttttaacttactgtaatatcaactgtctgtggtagcctgttcacttgctttgtccttagtcttgtgatccatgtctttttcttatctgttagttttatgctgtctcttcacaagttctttttctgcgtgtgtgtgtgtgtgtgtgtacacatgtgtatgtatgcaagtgtgtgttccaacaggggttcccacttgcccattagaagtttatgctggggtctagataataaaagtaagaaatccaggactacacaaatgttaactgagtggattgaagagcaagagagttctcatcacagccaaacctatgagcacaatgcattgggcatatcagagaaaacgaagatctaaggtaaggtgtgaaacacagcacatgcaactcgaaatgctgaggggaagatctggtaggggggcctggtttgtgaaactcctccgatctgggtgcgccagtccgggtgcaatgtccagctcagccacttgtccccatgggaccttgagcaagtcactccatgattccatgcctcaggttcctgctctgtgagttgggaataacagagcccctcccagtgggttgttgtgaggatttggggagttaatccaggtaaagcccagcacagtcggcattctataagcgtgagcttcatcatgatcatcttatcactttgcgtgcatctggccctcctcacttacaactactgcaccccgtggtagaatgcagcactcatccaacaagacttgcaactcacttcatctctaaaatgtaacaggtccaggtaaaaaagggcagattgaacttgtgggcttacctctagaataatatcactaaaagtagaaattcaaatggacaaagggaagaaagaagagacaacagcctgtggaagatgtttgcaaaatttggaagatggaaagcaaataagagaatggcagttgatgagtgaggggacctccctgccagaggatggggggagtcagtaaagggaaaggcaatttgcaacatacgaccctgagagctttggaaatttgaggtcactcagagggtgggagcagggcaaggaatggggctgaaaacatgagagtgtatgagtgttggagaaaggggaaattcaagtgctccctcctcctcccacatcccctttctgatcccctgcagccaggtaaccatcctgtgcctagcaggtaatttagggttcctctccagagagaaatcagggactccaggctctgcagagtgagggaatgaggcaacatactgaaaagggggaccaagtgaatggcaaggtacctcccccaggatcttccctctacttcaccctcagaaccctgcagccaggctctaacaaccccaccctcattccaccaccctttccacagctgacaacagcagtattctcccccaggagatgctgaccaacccaagagaaagagctacttagacagtcacttatgggtccccaatgacatagtcaggtgctgatacccatcacggcacacacccccagccaacaagccccacctgggcacacagtttcctagtgaattattctgaattatttcctagtgaagagcatccaaggtccaccagacacttgtgaaaaacttccaagcattagaaatgatgaccaaaatctaacaatcacgaagaaaaaatgtggagcaaaaagagatgttttaactttaaaaaaaaaaactatcattaagatcctaaagataagaacaaataatacagccattaaaaaaacagttaaagatgccttgaataaaaaggatcagagaggaggttcaacatctaaataacaagagttccaagaagagaaaacatttaaaaatggaagagaaaattctcaaagaaatcatacagaaaaatttcccacaactgaagaggcccactgagtaccccacataataaaaggaagaagaccctaaacaaggcacatctctgtgacatttcaggacactgagatgaaagagaaaaacctaaaacattcagagaagagaaatgggaaccaggatggcatcccaagcttcttgataacaacaataagagctggtagtctatgaagcatcactttcactttccaaatcgtgagggaaatgtttcttaaagggaatcaaaggcccagccaagccatcaatgtgaagaactacaccaaccatgaggctgacaggataacctggagacaggggacccagcatgaaaaccaacagaatcctagggtgccagagggcagagatgccaggacagccacgcctggaaacagccggttccatctgtgagcacagggctccttaaagcaccctcccccacaacaaaacaataaaaaccctgagagatgaccaaattcattctaacacactgaaaagaggaactggttctgccaaggagtttaagggagtcttattgtaagtacttagaaaaaccaaggcaataaaaaaatcattgaaaatcaatgaaaaatcaattgaaaatcattgaaaatcaatgaaaaatcaattgaaaatcaatgaaaagttattgtttttgaaaaaatcgaacattacagcacactatatgactcagttctaagtaacatttacatagttataataatgttacaaatgcatatcaacttaaccaacattatgatttacctacattggaaggatggagaaacaggagatgggggaagggggcatgagctaaattctcatctaccttaggagaaaattgataatgtctgatatggtttgcctgtgtctccacccaaatctcatcttaaattgtagctcccgtaacttcaacgtgttgtgggagggagccggtgggagatgattgagtcatggggtggtgtctcccacactgttcttgtggcagtgaataagtctcacaagatctgatggttttatgaggggaaacccctttcacttggctctgatctgtcttgcctgccgccatgtaagatgtgcctttcaccttctgccatgattgtgaggcctccccagccacgtggaactgtgagtccactaagcctctttttctttataaactacccagtctcaggtacatctttatcagcggtgtgaaaatggactaatacaaagtccaaatgaaaagctcatgaaaacgcagtgatgtatcaacaaggaggtaaatgacagaagaaacagctaagaggacagcagttacctctaggaaagggggctctctgggaaaatggaaggcagagaactgctatttttcattataagcgcagaaatactatttgacttttacaactatgtattagcatgagaaatataacaactagaatagaacagtgataaaacatgtagaaaatttcacagtgaataaactaacgcatacatagataggcaaccgttttctgagagtcagttgtgaacccagaaaaggcataaaatccagttcttcagagccatcccatgctcattgcatgtaccaccagtttgcttcctcccaaaattcacatgttgaaatcctaaccctcaaggtaatggcattaggagctggggggcctttgggaggtgattaggtgttgaggatggacccttcatgaatgggatcaatgcccttataaaagggaccagagagagctcccttcaccccttctaccatttgaggacacagcaagaagatgccatctatgaaccagaaaatgggccctcaacagacaacaaacctgccagtgccttgacattgaacttcccagcctccagaactatgtgaaataaagtcttgtttatgaccatccagtgtacagtattttgttatagcagcctgaatgaaccaagacactcatcatcagggctgttgcatctgccccttcccaccacagtctcactaaagcaaccggaaagaggcaccaaatacgtccccctttgttatgttagtaacacagtcatgttataatacaaaataaactaagcaatgtcaaacagatcaacataattatttagtatgacataaacctcttccaaatgcacatgcaaattttttcattatttaccttttaaaagccttaaagcttaaagtgaaaattagtgtgaaaaaaaaaacaaatttctgaaaggtaatttgtcagtctatatcaaaagattaaagatacatatctttcatcacacaattccactttcaagagcgtatctcagtctgataaactacagcatggtttgaaacagtaattttcatcttggaggcatgtgagaatactgattcctgggccccaccccaagacagcctgattcaattggcctgggataggacctgggcatctgcattctgcactcaagattgggaattcctggtttataatatagaaaactagaaacagcctgaatactcaacagaagaggactaggtagataaatttataatgacagagacatacgatggaatactagacagtttaaaagtaatgtggcattaaaaatatcattaagcatacctatgaacatgggcagatacttctaatgtgctggtaagtgaacaaaacaggtgccagcacatatatataaaagtgtatatataatatgatcccctttggggaaaaacatgtgtataagagagaaattccactatctggaatgaaatgcattacttttcaatagccattatgtctgagtgcagaaagatttaatttaaatacttttgttcatctgtatgctcacggtaaacaaagtattattgacaccatcttctaaagttcaaaaatgctgttatatatcacttgtaagttttaaacattttagtactgttcatatagatttcacctcacaccccaccctaaatccatatacacagacccactcaaactctcacctgcagattctcagagcacactacatcctgccaagtctccagcgtgaagaacaacttttgcataggtttcatctttcctttgtattaataggtaacaaagtctggctgcctcaaactcagaacatccttgcaacactgttacacccactgatcttccaagttcaccttcacaaatgtgcaagggatgagggggacaaagaccaagtcaccagcaccactcctgatcccccagattccagcccaggtaaaccattcagcatcattggtcaaaggtattgggtcactgaaggaggagaggggtagaaacaaggcattgattcaaatacttccaaaatatgtatgtgttttcccaagcagctgttactccccagcttgaggaaagtgctgagttacagatgatggagtatgaaacactgagagagggcacaccctgtgccttcgcagcaagaatggcagagctacagtggctttggtgttttacttcacccacttttatgcctactcttttcttagcgcccccttcccttactcattgcatcaaagtgatccactgaaaagaattaagtcaactgcagagttccagatagctatcctcaggagttttaaaacttaagatgaaagcagtcagggaattaagactaaatcccgaatatgtaagaaaagggctttcccacgtggcacaatacacgtactgtctgcttcacaggtccagcctggtagcaatcaggcaggataccagagcacgcaggaaatccaaaattaggttttactacctataatggaagatttacgggatggtttaattggtagtctcaggactaaaacctgaagcaggggaacaaaaacgtctatctggacacagccagtgagcccacgtgcaccccatgacactcgctcataggacacacaggcccgaggctgcaggggacagagtaaggtcacaactcctccttctcccaaccttgatgcacaccaaagccaacaacatgctatttcctgttccttttatttaagaggcaaatttgtttcttgtggtagaatgggtcttcaagctacacacacaaactcaggtgttccgcaaaacaaaagaactcattcaattcagtcctcccctgtatttccaaaccacaggggcaacactcacaagctgcaaagaggattccgccccaccgggaatgcatcggtctgcacctgtctgttgccattttcagggttagcagggccactggaaaatttcctcagtaccattttgggtcaatgtaaaggataattgaagtgcatgtttctgtaaattccacgtgctcagagagatttcaagtaaacacaggaaaataagaactgtgggcttgagccatatgttggctggccacgtggggcaggaagaacacacactgtccaggcagtgagtaactgaaaaccaagtgcccacagacaccatccactgccagaacttgggaagctggggtcccaagggacagtcccctctgctcaccctctcccctcctttctttctcaccctctcaacaaactttagtggagttggctttttttcctagaggccttcatagccactttttcccctctccaggtggtagcctgggacctactgtgcagaaggacacacaggtctgaattgaggtcaagccaggaagaggaagaagtgcagagcagggcagccactggcttctgaaatccaatggaagaggcggcaccatttagtagcatgacattctgtctgcaaaccaccatgatgatattgttactaagtagaagaatcccttttaaaagaactttcgatatattataacatactataacaagatgggaagacattttccttttaataaattgattttcttaaaggagatttcaactttccagtgatggacacttttcctggcttccacttgttttctgaaggtttccatttgggtgtgatttcttagcaaacaagagccttcccaaacattgcctgcagacatcttggtctgtagaaacaccttataaggagatcaacgtataacacagtctttttctacctagagaattagcaaagggtgaaatttggtatgacaggggtcttccctggattcctttcaatgtagtccaaggaagaactaacttaggctgaattctattaagacaaggttatcacaatatttacaagattatttatcaggattatatcaattaaatattttgggggaaaaaattgccatacaaaaatcatattaaaattgagccaagcagtgaaacaactctgaaatggcctagaaataacatgtatttgatattcactttttctgaatacagatgtgatcttcatgccatcattgaccccaggtggtaaggatcattaatgtttctagaatcctacactgggcagctgatgcctgtaatcctagcattttgaggggccaaggagggagcatctcttgagcccaggagttagagagcagcctgggcaacacagcgagaccccatctctacaaaaatattttaaaacttagccgggcatggcagcatgcacttgtagtcccagctacttgggaggctgatgtgggaggatcatttgagtgtgggagatggaggctgcagtgagctgtggtcacaccactacactccagcctcagtgacagaatgagactctgtctcagaaaaaaataaacgattttaaaaattttaaacccttaaaaataagtaaataataaattcctacactgttgtacagttaacggccccaattactaagctcaaagggaattacccagaaaaggcaagaaaaacctaagtgtgaactatggctatagagaaacaaatatatggcttgtaatataaataggtttcatatacataagagtgtaggcatacattgcaatgtatcatctcatctgaccctgctaccaaataaaccacaatgtgattttgctactgtggaatccactgtgaaacgagtcatatttcaaagaggtatttttagtgatttttaagggcaagaattcacagacttcagatctgggttccacgtgaccatgacaagcacttggtcagttctgcggcttgggctccaaattcaatgtgtggatcaccactgactcaaactaactctatctgtaagatgattcaaaagagacaatttggaaaaacagaagggaggaaagacttgagaaagagtgagcttttacaactaaacagtatttgcttgaatttaaacaccacttaaaacatagacaacaaagacaaaaagcatcagtgaaaatgtatgtcccttttacattccaaatacaggcccagaaagcaataagcaaaaggcacagctgggctctgtatagccgacttgttgatgtttaatgcaggtaccactctgatctcagcccccagatagaagcatatactctagtgatggcccaggaagacgtcgaccagcacaaagcatcaccacacttcccacattctgagttggatgcaaccattctcttagaaacctagtcttgactgggtgtggtggctcacgcctgtaatcccaacactctgagaggccaaggagggcggatcacttgaggtcaggagttcgagaccagcctagccaacaggacgaaaccctgtctctactaaaaatattaaaaaatcagctgggtatggtgaaatgcacctgtaatcccacctacttgggagactgcggcacaagaattgcttgaacccggaagatggaggctgcagtgagcaaagatggcaccactgcactccagcctgggtgacagagggagtctctgtctaaaaaaaaaaaaaaaaaagcaaaacaaacaaaaacaaaacagtcgcttctgcactcatggtaacatcctttaccatttaatctctcctagaagacagggcattgccataccattactcacttgaagatgagaagtggaggatttgttaggactgcaggtgatgaggagagactcaaacagaatgttagattctgaccgatctgctctggtttcacacacttctttcccttcctaagaatctgcttttcccttcatgtactttttcctgttttcagtatcactgggtcatttctagtaactctgcttaagtgatcctgtcagctacagggcgtgggtgggttattcagctctgcctcacagaacactcaccctccatctctgagtcagttgccttttaatggaaatactattcgctgatcatgttcataccggcccagttttgtttctcttgacaatggcccaggtgtttttctcttctgattgagttttggggtaagctcagcatctttgttgttgttgtttgttttattacatttccatttttactggaggggaaagatcagagtcaatgtgatccagctgctgcacgtcagtcccgccacatgacctgcactgttacatccaaagcgtgcagggaaaaggctgcgtgctcaggtccagaagttcataaaggcagcctctcccatcagctcaccggtggctgccagcctccatgccgccttgctctctctaggctactggtttttgcaaccttctgcttttgtccactcataactttgataagtaccgtgtcaccttctcatacgtggaaaacatgtggtcagcgattcggcatgtttaatggtgcttgaacaatacaaaggggagctgtcatccatcttttgttttctcattatcagttttcaggccacgttctaaacaaggacgacaaccaacagaacatcattccctggtgtcccagtccttgcttactttgaatctcctcaccaccttcagtcctttctaaggtcacgtacgggcatccaccgtcttttttcctaaacagaatactttgcaaagtcaagtattggcatttcgtatttaagccatgcatcctcaaggaggctaaaattagttcttgaaggatgaaaaacgtcttattccttttctgtataaagcacagatatacctaaatgtagacatacgtatatgtataatgcaaagtactaaaacagtatatctgtggtattaaattttcatgtgaggagggacaattaggaaaaaaaatcagaaaatgctttttaggaggttgatcatgaaaacaggaggttggtcatgaaaaaaaaggttgaaaaacactaatttaagcctaaatgtaactacattacaaaatgtcactacttcttgctggttttggcaccagtgcctcaggtgacacagaaatactaagttttcttttattctgatatgcttaaggtatccccaaaatgatttctctaagttgggaattgaaagggttatgttacactcattcactctttaacaagtcacatacacgtcacctcctattttagaagccaatgggtattaaagcacaagaaataaaaccactgaaaaagcaaaaaataaaaaggaaagaaataaagactcggcactctgacacagatgaagcagatgattatgtttatttaaaacagcaacttattttttaatgtctatgaactaaagatttctcaggacatcttatttcatgttaagtgtccaatgcagcaatctttgccttgcaaagcccattacaaataggcttgtgcattccagaaaggaagcatgcatttaactttcccaaatatgtaatatgcaattcttttttttaaattttttacttgcttggagcaaagactgaaagcaagtatttaatctcgcttcctttgccagtgcaaacgtaactaattctgatcctcatttccatttcttccttaatctttttaaatcagggttgggccagcatttattcccaaccttttggagaagtagcctgtatttcaaatggggccgcgatgctaccgcatgttgtcctgaccagtgccgtcctgatccttgctggagaaagaaatggaggcattttactcacaatcacagagcttacgtatgccagcattacagaatgcaaaaaataactttgcaacaatctgaaagggtaatttatggagcgtggacagtaaatggggtatgttttctgtcctgaaaatcccagatgagggcaggcttatgaataattttcaaaaatcaggaagtctgtggaaatccctactgtcttataaagattgcaccgtgctcatcgcatctcccacggcctctgcctcctcctccacctcctccgaggttccttggtcctgactcctaatggcaagggccaaagaacacaggcacctgcctccagcaaatccactccgattccccctcattcccagacacaaatttccatgaaaaccagacagaggacagaaagcaggggcaggatattccaaaagcacttcagatctgcagcctgatttcattggactcgctggcttgtttcttttagtccctgggtgtgttgactgcaggagaaacctcactaacgacgacacttcagaactgtgagtccaaacacttaaggaaggacgtgcccaggaggaaggtctagaagctcagagacagtgaggaaggggcattgctcagcgatgcttagatgccttcatgagctgactctactgggagtcacttgtcatgcccctgaatccacccacacatctctataacatatgaaaactgttcagcccaaaggaaaaaataaactcgatggttctcattaatccaagtttaactaaacacaacagtttccaagagtacatttcagccatttcgcacccgcagatacccaacctgagaagctgatgggaaacggctgttttggcatcaccgagggctgcggcaggcagcacccagggggcttctgtctcccctgtggcgctgcagctgagagccacacccatgagctgatgacgtagcgtttctctcaaaggtctcccttgatgatgtggcaaactgcaaggaccaagcacagaggcacctggacaccaacccttccctgcgagccacatggccagtcaaacgttctggttaccggggatgacacgctttttccgacaagattttaagcacttgtggcttacatcaatgtggtctcgtattcattgtgtgtttagaccacttgcctcgcacgttctcatatttacacatgttcactgaacgtaacctcaagtgaattatttaagaagccttaatgtgcttcagactgctcaaatataatttagactttaaattaaatttgtactctgatacgaaactgcaatgcttgaatgcagcttacggcatcaagtggacatgcaggaggccttggaatagaatttcagttacccctaaagggctcacacctagtggcccacgttccttataggacgaaacaagattcaactacaaaatccaactcattgcctacgtttgaaagctggggagcctgcagtacacaagataaagtcttgcttctccatttgtccttacgtgaccctacaatgaagcatcgctacacaccagagacgtataatgctagacgcgagaacacacagtcatgctccttggtcagaggttttgggtatggttgggtgttttaataaaccacaatattccttctccttcactgtttggttaccaataattgtgctgccttaggtgtaaaattcaatatggtgattagagtctagagaagccacacttattttatttagcagtttttgttttatttttacagtaagcactgcccactgggaaaaataaaccaaaataaaaagagtgaaattcccttattatgcactagcgataatgaaaacaaacttatctacaaagaaccacagacgagaaatttgcctagagaccagctactggaactaaaaacaaatttcttattcaggaaaatgtgaatgagtaagaatctgctagtgaagtttcttactttgcacaaaaaattaaatgaaatcttaactttaagagtagcataggctgggcacggtggctcagcctgtaatcccaacactttgggaggctgaggcaggaggactgcctgaactcatgagttccagaccagcctgggcaacatggcgaaaccctgtctctactaacaatacaaaaaattagccgggtatggtggtgtgcacctgtagtccctgctactcaggaggctgaagcacaagaatcgcttgaacccaggaggcggacgttgcagtgagccaagatcgcaccactgcactccagcctgcgcaacagagcaagactctgtctcaagaaataaaaattaaaaaaaaaagagtggcatagttaaaagggtagaaggttactcaatgacgcatcacgtatagtacacatatagcacactgataataacaaatggcatgtaagcactgtggattgacttcagaagacttttccataagcttcagtatcacaaacgaagggaaaagcctgtgttatgtgcaacctgtcatgatcaaatagtgtgaatatgtccttgtaaaggttaattctatagcaatacatttagttgatgtgctttcttcctctgggattctagcactttaagaatgccgttcttcaaaataatcaattgtattattctcaagaaacatgcaaaataagaaatttgtcatcaagctggaattatctttaaatagaggatattcaaatagcatttttatgcctggagttgtcgcagcatgattccggcaaaagccgcactatttgttagctggcacacagagttttggcctgaaattcagtattttattttaccctttaaaagcatgaagtgactcaacaggaaattatacatacatttttccctccaatgtaaaaactgcagatctagtaccgaacatgtcacgctggcattcaattttctattgctatcatatctggttccttagtgacataaggtcacaaaacttctactcctgtggccaagagacataatagatgttgcggttgctcattatattaaatttgaattcctaagctaaacattctagacctgcactattcggcatggtggccactagccacatgtgactatggagcccttgaaatgtgaccagcccagatggagacgtgctgtaaatatacactacacaatggattttgaagatttcatatagaaaaaaaataaagtcaaatatctcatccatattttacactgattacatttgaaatggtagtattttcagcatgtgttacataaattacattattaaaattaattccacctgtccctgtcttttttaatttggctactggaagatttaaaactacccttgaagttcatgttctatttcctttgcccagcactgccaggaccttacacggactctgcctccacgtcactcgctcccttccggtcacttccataacaggcccgccactctgaccaagataactacacacagcagagtcccatgggtggatctcagcatccgcctgcctggttctgatgctgccctggttcccactactgtgtgactccaggcaaggtgctcagcactcctgagcctcactgctattctggaaaatgaggacaattagagcacctcctgcaaagagccacagtgaagacagtcctggcaaagtgtctcctgtggctataccatctggtgagtgaatgtcacctgccaccttccacaacatcacacctctcccttcccttatgtaagactgctttcttccctacctcttaactttacacctgagatattgaagtaggtgtctggtctgatccctccaacactccagaggatttggtcagtttccacactgtgtgacccactcccaggtaacacttccaccctccaaacacaccagcaggcctgactcctccaccctcccgcccactgctatctctaccattcccgccaatccagatccaacacgccatggcacagctcaagggcctcagcctccgggtagcatgctctgatcctctgatcttcctatggaatggtgtagattgcttttggattgcatgattctattttatgttatttatactctaccttgttcccaaaaagggactcaaagtggtctacaaggatatatgcaatatgacaaggttgtttaaaattcagaagcaaaataaaaaataaagatgaagctaaagagaaacaagggtaagaacataaactcgagctaggaatgcaatggcccgccaggcaggcctcagggtctcacatatctgctggagttgggtcattcacacgtctccaaataatgaaatccaaccaaatgctcagacaatgactcctgatgctaaggctaaaaatgaaatcctccaatgattccataagaaagaaggacctgtgtgatagcaagcatgcccaagaacggccctacagcaaacccagtgtattgcacgaggctgtctccctgctcgggaacatctcctccattgccatacagtctagagccctgttcactgccatgctggcccagttcaaccaggtggtcccactgaggatgccactcttgttggtgtgtgaactcatctccttcgagatttcatgatgtgcacattcacccccgttctagatttcatgacacaagcattcaccccttttctagattctatggcaagtatgttcacccactttccagattgcacggcattcgcattcaccgcctagattctagattccacggcatgcacattcgcccactttctagattccacgatgtgaatgttcccctcctttctagactctgtggtgtgaatgtctgccccaattccatggcattcttgctcacctccctttctagattccatagcatgcggattcatcctctttctggattttgcctccctgaaggcactgtgcaagtcttctgcatagtgtcttgcatgaagtcttacacagaacataaggcaaaaacatggactaaatggacagcttgccttccaccacacagtctgtagcttctagcctcccttcctttgcacgtgcctttcccaggatccggagcaccccctctgtggatggagtcctgtatcttctcaccttgagtcaaatctgactgcccgctgatctctgcctactcagcattccctgaattctcaggcattccacttgtcctgtattaatttccacctgtaggtatttatcctaaggacaccgcatttagagtgtccttgcaagaggggatgctcctctcttcagctaaacttagctatttaaagtaaaaagggtggtagttttgtttacctgttaacacaactcatggaagagagaaaaattcaagcatgccactaattgctgcagtcagacagacaggtggataggcgggctccatagcggaatgttctggcttctcccactaaatttgcagttgttcgtctaatctctagacgtgtcccgtgtcttaacagtccctgtatgacttatgctcccacctcttgtttgggacagtgctctcatttaatagatgctcaatatattttaattaagaaatgtattttcacgttgcttaagacccataaagaacaattaatacaatgtaatgcttaattttgcaaagaaaaagtttatattgatgctaaatgcatttacaaatgtgctcgtaatgtacaaacaaatacagcccttactgtgggttacacatacttatgaaatgattttattgacttacctttggttttacaatttggctatggggtacttagaagaaactgcccttgtgggacattctgtctaatcacttatatttacaagccttagaaaactgtaaaaatatattcagtttcattaagagatattcgatcttcagaactgatactatttcatctataaaatccttttactggctgggcgcagtggctcacgcctgtaatcccagcactttggaaggacgaggcgggcagatcacctgaggtcaggagtttgagaccagcctggccaatgtggcgaaatcctgtctctactacaaaaattacccaggcctgttggcaggtgcctgtaatcccagctactcgggaggctgaggcaggagaatcatttgcacccaggcggtggaggctgcagtgagccaagaatgtgccattgcactccagcctgggcaacagagcaaggctccatctctaaataaataaatacataaataaaatccttttactttgatacctcaagtagtaatcaataatatccctctctgttctaatggcagggcctttaggtaaggtttcagaatttgggataaatactaataatatgctgatctaacatctcttctccagaagactccctagatttgatttttactgtcattatttctattttaaaactctgtagtgaagtaagttttactgtcggggtcaaatagactagaaagtacttttcaatactgaagaagcaaatttttcctccacttttgcttattctgtcctcttgctgctgtatcttgaactgcagaaaaagcaagccttgcacaaggcaagtttaaactttgtgcaattatagacccagatttgtaaatctggcagcaggctcacatcagctttgtgaggttgggtataattttaatgagaatccattcaacatatgaaatcttagaatgtttctcaattagcacttggtttcttttcaaaatgtttttacctcatttcctaataaaagaaatctcagctttctgatacatttaattaaaaagttttatgttgagattgtaaatgtgagtggtttctgtttcaaaacatttcattttgctagtacatccttcacttattatttatactctgcttagatctctgcatttcccatgcaaaaatcctgaaatgcaccttcttcagtgctgaggtctaaagtttccccttcctaagtagtgccacagtcaccccctcttcctcccacagggccctcataatagcttctttcagtccttcctctgaaccctgagacccccgttcactctcatgtcaagcagaattccaagccttcattgcacacagaggtgggtccagggaggtatcccgtgtttctgaaattcctgctttgcctgtgcctaagcttcccaattctcccaagagtcctcattttaagaacacaatgcaatgctagcattgcactagcattcagcatctcccaccatacattgcaaatggataattagcttgattgctaggagattcacctgctatcccctcttctcaccctttagcaatgtgtgtggaacgcacttggctccgaacaaattaattgtgtgtgaggggtgacatctgactacgaacaactaaaaagaaccatttaatcaggccaaattcccttcaggcttattgaggcttgagtgtggatttttaaaatgtaagcagcactgtcactgtaaccatgaaactgtcatggttttaagaagtgaagttttgggggacaacaacatgaccaacagactctacctcagcatccagttcccagattagttaatacaaacttgggccccacttttcaacagaagcacagctctaagtaaaggctggtacccagctctgccccctcaaattatttggtgaacaggccaaatgggaggaattgcaggtagtactgcagaatctgcctgccttggaaaacaggctttccatgaaatacagttttaaggtccccagaggccagggctctctccctcccctactcttcaccgcgccccccgccaacccacacgtgatgagaaaccactgcccctgcagaggccccagcagcaggcaagggtctgtggaagaaagagaggaatattacaaaggggtttctggctggaggggggttccagggagggcagagaggttcaggctccaaagctggcagcagcccctacagatggaaagctccagtgacaggacccatgaaaggacactgcagagcttgtcccatgtcattgggccatcgagacatcaagggctgcctggatttcaggaactcacatctgtagaccaagaaggaacagcacgttcccattgccaatttcaatcaatttattaaactaaggcaataggtaagtaacagatttactaagatattgggattctcttactgtccatcttagttcagatggagattcacaacaccagctaatctgattccaggatgcagcttctgacggtgcacaagctaatatttccttaagatagtcacacaaacctccctgccaggcgtgcagaaaaatgtgcacgctccaatttagtctttcttttactttccaactttaagtactttagtgagccccaagaatgcatagccactctttccacccagttagagagaaaattaatctttctaccaataacagagaatcacttaatggaaataggacgatagtacttcactaaataaggcttcgctcctttgctcccctactctcaaaactgaggttcaaatgcatttctacactttcaaatgaacatgtgggaacttttgctgaatgctgacatcaagtgaaaataagggtttcctattttttaaaagtcattctatatatgcctgttttctttcctatttcctagagagacagcttttcccccccgagtatgttttgcaggggtaataattactgcaataatgttatccttaaaagggagcacatataagacaaaagcaggtacaaaaatctcattcccactaaaacaattcaaaatcataggttaggctttaaaaggaagcaactacaaatctaggttttaaaaacctttagacacactaaagatttgtcccagatcacatctgatgtctatttctctgggataataacaaaaaaaaagaggtgataaattaattcaaatggcctattttacatacttgaaggatatttccattgtctcatatagccattctgaataggacagagtcacataatgaaacttcctttgcacattctcctgaacacgcactgagtcaagatagccaaaccccttactttcattgtaaaattactgtttctcatacgcaatcagggtctcccagattatgacatgcgaccctaaaaataggagaacttaaaagttagtttaaatctaaaacttagatccagcgctccatttttagatgcaccctttaatttcttggttttgtctacattttacttatacttaaatttagcaaagtaattttagctcaccctccttcactaccttcactagactttgcaatgttacaaacatgaagcattcaagcctctttctaatatgaaaatgttttaaataaaagataaagttaaaagggaaagatgccccttttaactttaacttttaacttttttagctatgttgaagaactggtttgggtgacagcccagccattggaaaagccattggaaaactcccgctgttgtttatttacaaaataactgctttcaatcaatcattgtgagaggtccgtacactgacaatgcataatggacaactaattaactgacccctaataagagtgtgggaaataccagggagaatgctatcatgcaaggaacagcaacaatatggaggggtggctggtcactgccaagcatgagcatccccaaataccgcagtgattttcagagttttcaaaaagccctactcacaccactgccactaagtaccataatcatcggaaactgtgccccaaagatctgaacgtccctgttacatcagcctatttttcttacaaatgttgctgctaaggttcaaattcaaggtgtagaacattaaacaatagctgtattgtgaaggaccatgctccctgggaaagcccaagtaaccttacacactggggaaggaaaaaagaactcctttgccatactcctgctctctggaaaactgctcagacgcaaggggtaaagaagcaaagaggtgacaaaaagagacctgcattcagagagatcagctgtcaacttaaactgagaagtgacctgatgcctcacagagctgggattttgccaccttgaccaaactgcttcccaggctccataagtctcattagaaacgtaggtggctctgtgtcgacaccttctcaatggagttctatgaaataacaggcatcagacatttattcactatgacaatgtcttcccaccactccagatcctatgaccgggactgacttgctatcggtttttgcctgggaataggaaacgattccagaaacattagctcttctgttttgagaagaaataaattcccccttttatttcttttttgtttaaagatagcaagataaaaataaaaactaatattacttttagaaaaaaaaagtgttgaaagtttcctattaccctacttacaatgtgagatgcatttaaaagatacataacgtataacattgtagaatagtatgtgagttacacattccttctgacgtctttcagagatgctttccttcttacttatgtatctggtattccattgggatcttaggtcttaccacaaataaaatatctgattttataagattaaaaactcaacaaggtttttctttaatataaaagcaaaacgtggaacgtggaggggggaatgtttatatacaggtgtgaatgcagcccctcacacaatcccttcaatggtaaatgctaattttctaaattttagctaaagattaaatcaccaataattcctcatgaaataacagataaacgtgaaatcatgtactacaattctactctaaatttttttaaatagaatgaagtaattataaaatgttacaaaagagaagaaactggaattataagtgctactggaattatatattccttaacaaatatcttgagacggattacccatttgctaattcagtgtactttccaaaagccattgacccaaaccgaagctaggattaccaaatggcaaatagcatttgtgatgtgtgtagctcttctaaagcctttcttgagaattgtaaaacttgatatattagccacaagtttacatagctcaccgtttctgctagaattataatttcaatggtgtaattagcttattaataatttgacacatggtgaattaatttacatggttgggttcttcgcaacgtctgttgcctgatcctcctgtggatgaaggctatgagctctggcctgccccgggagcgggcaccagccaatgccagcggagcaagggttaactttgggactgtgacagttctcccttcaggggctctaaactacttggagagaatggaaaacagtcaaaaatagtcccaaaggtaaataaactctgtgtcctatgtatgtcacccagggaagaataaaatgtatttttactcacattgaaagttttctgaactacaaaagctatagagacatgtacagagtgaaacctgtagcacatacgaatatgttattttgaaagataaaggaaactatctttagattaacgatgagttgtattaaatccacatcctcattgaaattgtttatccattttattgcgcagtgtagtctgctattaataacagaatttgtcctgtacttaaaagataattaatgcctctatgcatctatgcaacataccatagcaataaacggacgatgtatttcagacagaaaccaggtaaggctagctgataaaatacagactatattttttttaacatgccaagttttgcaattagggtggtaaactggaggcaaataaacttaacagctgcaggctgaagaatggaaaggtgaaaagactgagactgagagtgggaaaggaaagggaccgctcctggcgctgagagctggtcccagagccggtgttgcggggtgtgcgggaaggcgccgtcgggggtcattccaccatcaggacccagcggacagtgacaacccagcctcaaacctggtccctactttaggccaagcgtcagcttttttagttcaaccctgatttccactccagacaaggacaaataacctcttggtcggggccccagatgaagtccccgcggtgtgctctcctggcccttgtcaatttcggggtgccccctcctctccatccgcacccgactgcacgcgcctccctgggaccccgcactggcgagccgtccctcccggcgctggacgccccacctgtcccggcgccgtcggaagagccctgcagagtgagcccctagggccaccccgctgccttcctccccgtccccgcagccgctgtagccagcgtgggagccgggcaggtcgcgtggggcgctggacttaccgagaggttagcgccgccgtcgggggagggcgtgtcccgcacgtgtgtgtccgcgcgtgtccgcgcccgcgtgtgccagcgcgcgtgccttggccgtgcgcgccgagccgggtcgcactaactccctcggcgccgacgggctcagc

SEQ ID NO: 1006 - DNA, 281756 bp, Homo sapiens
tttggtgtatttttgagtagtccaaagtaatttttattctctaattagtcacctcacgactttatttgaatgaattaatgagaagctaaataaactagctttttaaaaaatattttcttctctttctccaggcaatgggtcactttggggcgctgcagaacatctgtgctttccctgtgccccatcaccttcccagctcctgagctgtagccatctctgctgcacctgctgtcagagggcagctcctccggctcctgctcctgggttgcaggtgccacatctgtgcagaaggcttaggagaagcagtgagccttctaactgcagcagtcctgacaaagcactttgtgaacccctccgggacataagggcatcaaactaggaacaaaaacacagtcttgactgtgatttggtgattttaccacatacaaggcccgaaagccaattgaagacaagaaaagaagacaaatctcttgccagcaggagtaagattgtacaggagtctgagtatacatcagggcaagccaagagacagggacaaacagagagaaaaggttcatgcaattatgaatatgacctggagggggctttggaattagattacaacagtaacagagagttaatgccattttgaaacaatttaagaattatgtatttgaaggaactcagtattatcatgttatccaaaattatcccagttgctcataagacttgctaataacctggactgggggtggagggttgagggatctaatggaaaacatctgttaaaattgaatatgataatcatgtcttgtttttatgatcttgctcatgagacagtcttgaagagagaactgagtgattatccaagtaaatgtgtatttctatgaagaatgtaggtgtgtcttgactttgcattccaaaataaaaatgactgatcttttccattagcacagtttgggtcagcctaactgccagctttcatgattgtatttatttattttccctaaggagatacgggcactttgtgggccttcccaggctgctgcaaaatgatggatggttgggctccgtctaatccaaatgacacggggtgtcaggagcattggtaatcgtgtcctgccgacttcaaagcccactgccaaaacatccacagcacagaggtttggcaacttcacataatcatagcaaaaggactgcaacgtgaaaaaaacaggccctgaaacagctatgaaaagggccagttcagaaacctattcagctaagatgtttcggctagcgccttcgcacggtcaccttgtattttcaccttttgagttgccttcacctggaccaaggttggcagcatttgtgattcaaagaaaagatgcccagggaaactgactctagattatggaaataaacattgtcttcaagggatagccagcaacatcaggctcagggctagtgaatcccaagccacagtgcccaggtaactctgatgtagcaggactaaagctgtctacctagtgagagctcctgaaagagaaaccccgcagcaaatctagacgttatcccttgtttctgtaaagtgagaaattgcagctatccatgacgctttatttgccagtaataatacagtttgccttacgagtggtagcttgttcactgttcaacaaatgtattttaatcatagcaggaattaagggtgatttgtgaccaggtgctgaactagaatttctcaatgacaaccccagcttcataggcctctttccattccaggcataaatatggaggctccaatgtgaaacccggggtccttctgttccaaaaggggctagaaataaaagacaggaggggaggcaagaaggacctggagaggctgacgccatttgggtgccaaacatcctatttccttggctctcccttgcacaagttcctggacaaagtaaattataacacaaaatccacaacattcagcacatgttttcattaagcaactttagtcactaaaaaaagtgcaaatgcagactcctgtataaatctgatttgccatgctaggccaagcttattttattacatacattctgcattctaagaactaataacttcatattgtaaacattaagcatacagagttaaaattcaaggccacattatatcgattgtctcttttgtcgtgtgtctttggctggccgagatcaactcgtagtgtataaatgcataagttatataattattatataaaaagggggaaaaacattgacttgtatacttcattctgacaaacgcacagcgttcgcgactcaaaggaaaactggaggccgcctacccaaaatgcctgcgtgatttctgattgtggcagccaagaaggccatctcttacctgaccctgtggagaacaaagcccccacataatgatgaggtcctgaatgtttctcttaaatatcagacaattccagttaaaattttcatttgacaaacaaagaaagagatgcgcatttttgtttctgaattctactacttcccctttctccattacgctgtgtcctttctcctaacactgggtttggtataacactgactgcatgaaccctcgagtctccataactcattgtacacagtccccaaatgtcctgagtccagtcttcattgcttgagaagtttctttcccagccctggtctcctccttctctgcctcttcctcctccttcttcacccctctgtctacaatcacacgctcactctatacacatcctcagtcccaccttttagttcatagtcccggtaatactgtaaaggagttggaaactttgggtcatcttcacagtttgagaaagctgacagctgtccatcaaacggaatgtatttgatttcaaccaaaacagcacatgccatgcagttgcatatcaacgtctgttgatgggccacagtctctctcgtgtcttttctcttgtttttgatatgtttctatttttaaatacaggtagttttccttaaaatggcattataaacggtatgttaggtcaaaactgtgttgtttctattgctttagtttcatcccagtttgcattagtgggattccaaactctactctaaagtttatacatttcttaagaccactttctttggcactttgtccttaagacttcatgcttctacatacactgtcttttacaaggtcagtccacagatgatatgtccatattcgtgacatttttagcatcctcctcatttctgtagtaagacttcagtaactccctcccaagagtctttggatctcttccccggcttccttccccagccccagtaaagcttttttcattcctcttgaggcacttttgattcatgttctccgatagagtttgtggcgatgggctggtgaatgcacgctgatgggaaaagcctccgccaggtctttagtagtaagtgcccagatgagaaggcatatggctggtggggagcctagtgttggggtatatacccccagttggtgaattccagtatgggtttggggcagcaaaaaaactggaagatgtcacggggagggctggagggtggggcgccacaaagttcatcttctgtgggtgggcgtgataggagcccatgtacgggaggtctgaggggtacttgtacagagatgactccggggggtggggctggagggcctgggcgatcccgtggaagtcgaacttgtaggcgtagcgcttcccatggaccttggtcatgatgttcttgtcatagtagtaacggagggcgcggctgagcttatcgtagttcatgttgggtttgctcttccgctctccccagcgccgggccacctcgtcgggatccgtcatcttgaactccccgttggtgccttcccaggtgatgcagctggagttggagctgtccgacaggagctccaggaggaactgccaaagctggatctggccactgcctaatgaggtcaggagaggaaggaaaactccagtgagcacaggttccaggggaaagaggctctctgtgatgacggaaggaggtgctattggtgtgccgcccacattcccttcaccaggcctgtccgtccatccctcagctgcaggggtgcggactgctctcgttccatggccacccacttctccagagaactgcccttgcctgaacagagccgccgcctcgcccacccccaggtatcccacagctgggtggactgaacggggtaccacgggccggcccccttgcctcaaggaaagaccaactccatgacgctattcaggcttcagggctcccgtgggattgggctgaaacagcgtccagctgcaaggaggcttggaggaggccagaaacttccttagcgctgcccctgcagcacttcccattctctctctcctgagaacatgccgttaatcagtcacctgcacaagcaggcttaccccaagctctgcatcaagggaacccgacctaggacgatgatctaacagattcaagacctagatggaatgcagcgaattcatatggggcaaagttcaggctgcttccatccatttctgacgtccttaaaagaacagccagatcaacctggtgtttaggggatgaaagagctatatatttttttttcctattttgtgaagcacaaagtactgttatgtggatggcaataatgacttaatgccatttatattggctaggtcaagtaagataataaaagttagatttaggaaatgaacttctaaaagtttatggaaaaaaatcgagaatggaagtaaacaccattatttctaacataacattttgctggcgctcagaaagcaattctgtgaaaacttttcctagaacagaattaacccactcaaaatgaggaagtttaggaaaaaaaaaaaaaaagctggctctttttcaaaccagatcacccagttccagtatttgggcaagcgcatcgtaacggaaaccagtgccttgcctgtgtgctgcaacgccaattgtgttaagcagcatttccagaagaaaaaccccaacaatgagtgattgcaagtccccttgggaagctgaatgagactcttcctttgtcaaagagatcacatttagctgggtggacaaagtcagaattttcttgatttcattgaaatcatacagatacagctttgttttatgaaattcaaagaaaaatctaggcacatcattctagctgctatgttacaatacttgaagatagtttatggctccctagaagacagcagcatgtaaatattgacagcagtatccgtaccaagagaagctaagctgtgctgaacatatttcagaagcttaagaacagatgggaggtgggtctttcctcccaaattccagttacagcactgccttagacttattaccaaaagattaccttttattatagtgtaagtaatatcaatcgatgtgataaaatgattaaagtaactttaactgacatctactcagggaagtaatatactgtaaaaatcaattttacgttcattttcttctaaatcctcgctagcctcctgtacatatcacccaacttataaactctgctttgcatgttggctacatggacatggatatttttgtgaatttatccatacaatagcactgtgagaaaggtcagctttttctgaatctatgctggaaagtgctcattttcagtctagcaacacatttgaaatgtattaacagcttgtagctcattgaagtggaagcctttgctttttcagaaccacatatacaaactgttcccaatcaagttttgttgcctccaacattttattaatatgcatttagaaaatacaaagaatggtatgagaaaaccatatggtcttagtatatatattgtaaccaaaaaattacaacttgaaaaaattccgtatatgacctgggaataggaaaaggcatggatttttgatttaacagtctaacagatgcttcaatataaacacatacggttgtttgaaaataaatattcagcgtcaactttctcccatagagaaagcaactccacagacctgccgaaatcacacttggaatctactcaaaccttggcattgcctcttagcaatttgtccctcacccatttctcttataaacgtgtgtaggacagaatcagtggacaaaagtgatctcatgtctctcctatttctgaagagttagaaagcaggggacctaaatttgtggcagcaaactctatgcccaaaggatggatgagctaatttctcacttgactattttacccagtagccataaagacatagggctcaggactgtgagaatttcaagggagggtctatagaaataagagaactgtaagcaaaattcatcagctttcaaaccttgaaagaaacctggaaatgcaaaatcaatgaatgtttaagtaaatggtagaaagagtaacatcatgtcaaactcattaattgttaaatttaatatttgtaacaaaattcgctgcattttgcagtgtgtagaacaaaatttctcactgcaagaattctcaaaaatgaacaatggttgttaaaaaattgtcagtggtaaaggaattattctcagtcataaaattttaagagcaatttttaaattcttattttacttccaaaacaataacatttaatgtgtgacgaggtgcattttagaatatagaatagagatttccaaacaagaatgcttagggtttaggaaagcctaaaagtggcttgggtcactcatgggccaaaccaggatttacaaagagaagttcttgaaagacaagagctttcattgagtagcatcaccacctctaccttaggactcacctttcttgggtaaacccttcagatctattttttttttttactctctcttaataacatccttgcgatgtcagtaaggaggaactaattttttcttagggtaattaccaaaataaaacatatttggaggtaaaaaacagtggcaagcagcattgtccacctacagagaaccctgtgggtgaaagggagcggctgtggcttttaagaagacagaggcactcctttaattttacagaggaaagtaatctcctaatattgttaaaagaaagggagagaaacagggtagcaaaggggtacagactgagcaaaaaagggggaaaaaaaaactaaacggtttacaaaccacagagcaaagcagagagctgcagagtgagtcagcagctgtgtctggtggaaacagcatcctggtgcaaagccctgcagccgtcagctgatgaacaagggcagtaaatacagccgtgaggggccccaccagtaccatgtggcagtggtttggggccactttctctagaagccaggggtggtgcagaagatcccgtgtgcatggcctggaccctctgcaaggcagcaggtgtgtccagcaggtgtgtcctgaatggaagtctctgccccgaggctcagtgaggctcaggcaccacttactggaggggcaggaaagcatggtggtagggagcaccaactttggagttgccactgcttcagctgaatcctgcctctgccctttgtgggacgtttggcaactctcgcagctctctctgcctcagtatcgtcatctgtaaagtgggggtgatggtaatagtactatcttgcaagatcatggtaaggatgaactcagtacttgaatggtcttgtcagaatttctttgggctgaaaatcagagtttaaggaaagataacactcctctcctatagccaggaaatgcctaaagaaagagaaatactgttcaattggcctattgaaccatgaagaagcttgaaacggtgctattcttgggctgactgatatcctctgaaagcttactgtgtgccatgcaccattctaaacgctttacatgtattggtttatttaatccccacaggaatcatgtgattagtccattggagaagtgacgaaattggagcttagagaggtagactgacttattttgcttagcgttggcaagggttgaaatccagactctaggctgccatgcttaatcactgcgcaaacttgctttcaggcctggtttatgcacacctctgtagcctcctcaggtcctttccatgttgtcccctccctgggggactcccactggaagactgcacactgccacctcctaacaaatgggaaaacatccctagcctggtctgtcgttctgcaagaggcaggatgtattttcatgtgcaccattgaagagtatccagttagcatcaaggaagcctctgaacataacccaccaaagctctttcattagaggaaccatgttagatagattctcagctgctctgatgggatgtaaaggagctgtgttgcttataaccgatccatgatatcagaatgcagggacacactgttctcagcaggaaaagtgatgtccaaagtacacatcaagtgaatatttgggatagagatgttgggatgctgacatcatcctgtgcattcatactatatgatgcaatctttccacttaaaatgatgaaaaggaatttgtattgtatgaagagcaaagacagcaatttttaagtgatgaaagatttatttatcagagaatagaaaaatagaatcaaacaggaagaagcattgtcattaatacaaagataaaagacattctggtttcaggggaaaagttcacatgagcacaacagacacaaacctaaagatagatggagagaaagtcaaattcatcagaaactaaatgaaataaatctttatcttaaagtcacttgcctgcaaatcaaagatgggatgttgccattttctccaggcccattaagaacagtcttaatggtatgaagcacagtcctccttccccaggcctgtgatgagtttccggtctccttgctctgagctcaggtccctctatctacaaagggcatccccgggctgctgggcccagggcatatgcagtgttcccttgtgaaagctggcactttgcttaggagcaagtgactcaggccctattctacaaacaagccaagcagtacctttgggctgtgacaacgtggtcatggacatatatgtttcatttggccaatgtgtgagtgcaaaggccagtttggtcttctttggtgcagcttgactctttcctcctcttccttcctgacctcagattcatcgcctgcacctaagcagttatgaccctgaaaggaaatccttgctttctattctcacagtccgcattttgtaagacctcctcttcccttcatacttagtcagtggcagagtagggcaagaaaacaaaagtagactttgcagacagagtcaggtttctaacctgacctcccttatcattggctgtgtgacacaggaaaagttacttaacttctctggacttctaattccttttctgtaggatggagatagtaacctcccagggctgttatgagacacagaagggaccacagacattctatggggggcattctgcgggatgggagctgtttgattgttatttcacatgattgtattaacattcccagagtgtttcagcttccgtcattttcttttttctaatctatcctgaacattgctgccagatcagtcttcctgaagcatgactgataataatcatctcaaaacatagtcattatttttatttgaatggttatatggcagagttgcaaatgaaaagctgagcagaaggctgagaagagaccacagcctcaggagcctgggctactagatgaaagccagcatgagcaaaaagggcctgtggctctgtgtttgggacaatgttgtaactacctgtgtccatctctccacggaccaaaagcaccctgagctaaaggactatatctcattatccttggcattcatgtatgcaacaaataattattgagcacctagtctaggccccaggctaactagttttctttagattttcagctgtgtaaaaaaaattcattgaattcattaacattaaccaaaatttaacttcaaaaatacagatgttcaataatgataacatttcgtgttttcaatgtgtagattctcttgcagggatgtacactgattaaatcttaattattccatttcgaaccttattttggcctcaacgtttaggaaatacacattccatcttgtgcttgcaatatgcctgtaacatcttggcatttgaatttgcagttgggaatatgcagcataggctatgaatttctgaagctggtgccagcacagctggttctgatctgaatacaaacaaataaaactatgtggttggcactgaaacactaggacaggtgacaaaccttggcaatgcactggttacaaatgggctaattaagaatctgcactttcttctagcatcgaagttcagaaacagaccatcgaagatgagcctgaatttgaagtcttgtggttgtatcaaggctctcttttaaaaaatactagttattttatctgcttgtataatgggttgaattgtgttccctcaattccctatgttgaaatcttaacccgcagtatctaagaatgtgaccttttttggagataagatcctaaatgaggtaatcaagttatagtaaggttatggggtaggtattccaacctgaccaatgtccttatgcaaaagaggcatttggacacagagactgacacacacagagagatgatgatgagaagagacacgaggagatgatggctatctgtaagccagggagagcccccaggacagatccctccctcacagccctgagaaggaacgaaacctgccaccatgacactctgatttcagacttccagcctccagaactgcgagacaataaactgttgttgtttaagccacctaatccgtggtactttgttacagcagccctagaaaactattacagcttggattaggttataatgttctttgctgaagctgaaatcttaatttataacccaacccatctttccattaaggcaaataattcagtgagacctaaaactaaaatctgttcagttgaaggaatttctcaccaataccaatttacttttcaaaataaccactgccaaaaagtaattttgtaagaagaaaatcatcagcagtttctcacctggatttgcaaggcggctacttgttggtccaagaatctgataaggatctacagcaaaaagaaacaaagtcaaatcctagacatagttgtaacatagtatgatgtgacttcagacataatgcctgacttaattgttttttcagatttcagagccgaaaatgtcctccaactccaaatcaactgcctccacctcctctatgagagaagatgtcacacggcatctcagatgtcttgctaggggactcctaattggtggcagggcttggattcaaccccaggatcctgacatatagctcaaggctcacaccaaccaatgatataaagagggcaaacatgtgccaagccccatcaatccagggccgtgcaggctgtgttgtttaggcatggaaagtaaaatctaaaaaattaatggatcacaaagaagcagcctgtgtgcacgtagaatttttttccctatttattgcatagttggggacgtgttttagcaccatctcaagtcacctcgcatgagtaggctgatgacttgggccctatcttatgtatggagctgtcgaaaagaggcaaacaatcatgttaatttccattaaaaagtgaagcattttagaaatgtgctgctgagcctgaatcttctcttatggttatccagacggcccctgaaacatacctaactgaggacgctggtcttcagttttgggcactgtggaaggagatggttgagcagctgaaaatccagaaatacaaaaggcaattagctataacagatttggtcactagtctttgatgttgttgcataatcattctatcagttaatttagttattaacataatagtctaactcagaagcatctcacggtaaggaaaaattttcctttctgatgaaatcaaatgtaaacactgtaacaaaaaaagaggacatttccaattatttaaaaaatggatacctcccactttttccaaaagtaaaaaaaaaaaagaatttggaatggcttaccaaacagattacaataaatcatagtctaagataaacacataaagggaaaccaccagtcaaataaagtaaagccagggatacttttaagcatggccaagattcaggaaaacaccgattatttaatgtgtactcaaacatcccatgaaacatgcatttgtgaaggttgacatacactacatcattcctttatttttgttatgaaagtcctgatgacccaaatggagaaagaatcactgcagtgaaagatcaattgtactcttgtcgtcaatggaacaaacccatcacatgttgcaaaatcacagattaaccacagaaattattatatactccatcaacagtcatccactgcctgtgacatgaaactcagggtcatgggagccaacactgtacctttcgactggggcgtggggtggccgtgaccggtccaggctgatctcctggggggctcatatggtaaatctgtaaagacaaataaattgactaaaagatcaatcatgtaatttttataagagatgctttggttttttatttgattttgtatttattagaataaactttgtgcaaaaaaatctggtaatccaaagaaatatcccactagatttgagttttatttacaaattaaaatttcatatattatagtggtctaaaattctcacccgtttgtctgaaaacttccattggcagattctcccagagctttccaactcttctaatttcctacaaccataagtcaagaccccaataaaagtttcttacaatctagttcatcctgcttccactgggactgatctacatctgtctctttattatcttcatgactcatccaaagcagagtctacaacttggatgaaccagcccatttttgtttgaggtctgttcctaaatcaatcaaatgacattcagcttctttttcttcttgcatctcctgggaagtgatcgctgccttatctttttatttgccagctgcctctcttagccaactcccattttccctttataatctcatcaatttatattaaatcagtcttatctgatctagtgattttcataggcaaatgtctcccatttctaatgttctaaataaatttagaatttctctaaaatgacctgcatgaaatgaattacaggactgaaatagtattgctcccacagcccattaatgatgaccttctgagcttaagcatatgccaaacatttctttgtatttataaagtcgtatcacttgtcctataaaccttcatttacttttcatatgcaaatttaataactatacttctgcatcctcagtgtgagttctattaatgattatcaaagctctatgtcatttcaagtttgtttcaaaaatatattacagaaaccttattataatactcttgctaagagtgcatagctaaggctatttctacatgcaatcttattacataactgtttcaaaattatgtcttcttggattgcttggtctcagttcaatgtcatgtgtcattctgggccaagtgaaggccatggccaaatatctcagcaggtactttgctgccagacaccaggagatgtgtacaaaatttcacttggagggtaggacaatgcaattgtttttaagcttctctttaaacaaatattttaattttgtttaaaaccagcaatttgatgggtcaatcttcaaagagcttgactgtgttgcagaagatgtgtctcttcctattttcatatcccaaagagaatagaaatgatgcgcaacgtgaaagtcaacacagaatctccttaatgtatttggtctgtttggctgcaagcatctttgctactagtgtggtctatgaaatcctacccttcagagctttggagaattagataatttttctttttaaactgatgttactcctctctctcagctggcatttttgcatttttggacgtaaatcttttcccacccagatcctcagattttcacatctcttgtgttggggttacacataggaattatatctgcagcccctaacaatttacaactgaacttcaacttaagtctctgggaacactctgcacatgggttctcagtcagttgcattttgtctaaaataaactggacagccagagtttcaatttgcaaattgtctcagaaagaaaaacctactcacaaggcaatcctagccacatctaacctaatttaggagcagaaaagcacattaactaaggccttctatttaccaaatgaaaaaaagcaagataatacagaaatacagaaatatgttctagatctctgtttctcaaagggtggtctgtggaccagcaacatcaacaatacctggtagcttgctagaaatgcagaatcttaccccagacctactgcatcaaaatcagcattttgtttattatctttttttttttttggaggtggagtctcgctctgtcccccaggctggagtgcagtggcgcgatctcggctcactgcaagctccacctcccaggttcacaccattctcctgcctcagcctcctgagtagctgggactacaggtgcctgccaccatgcctggctaatttttcgtatttttagtagagacagggtctcatgctgttagccaggatggtctcgctctcctgaccccgtgatccgcccgcctcagcctcctaaagtgctgggattacaggcgtgagccaccgcgcctggcctcagaatcagcattttaacaagatcctgggtgactctggtgcacactgaagtctgagaaagcctgctctagaccattgctcttttcaggaactctgttcctgcagatgatttcagaaatgctatctagagtgtgcaaagacaaactaaaaaatggttgaaagagttctagatggattgcttttacccatggcataagtatgctaatggaatgaatagacagcatcagtaggttagtcagatactaccttaaacataaaattgttgctcatgaaatgtgactgggaaaaaaaataaatgccgaactactattcccaaaatattttgaaactctttattcacaaaatccttcatatggtgtataaccatatcccatcctccctcgaaaataagtcgaaacttaacaccaaacagtctacttttcagccaagtatttgagacagttatatgaacaatgattcacatgttcataaacatattgccgcggaagataagtgggcttttgttttcttccatgacattctggtccaatgcttccttatcggctaccgatcacatgctgtgggcactaagtatccccctgtgggatatgacattgggaaacattcaactcaggctcactgagatgggggacagccaggggtgacttctttggcagctacaccatctcaaaaccttcgtagttctgctcttgactgcttgaaaaatcactcctctatgtatctttgctatgtgtcctttattgataatagagcatcagacttccaataagaatatattttacatttaattttcgctgatcatttcaacaccctctccatttctctttgactttgatcttcaaggcaatgaactcatatgcttggcagaagtgcccatgtaagggaaggctgctttctggcactggttctgttgttttatctgtaagagactgtgtttaaaaactgagctttatagaagtcattgcataggcagcttgggtgaacacagatgtacattacatcacaacagtataaaaaacagcatgaagctacaaatagggactcggctagtgctgaccactacacaccagcaactgtgtcgatttcctgggagctgggatcagcttctcattctgaatgagactcctcctccaccacacccttttgaagacatcactaaattaatacaacattctggctaccctttcctggagggctaagttcagccaagttttacattctcccttcatcaaactcactgaggaggaacgctctagctcttgccccacacaccccacaccgccaccccgctgcctacccgctttattttttaaagggcaagaatgtggatcgtggaagagctcatcctcattctgcaggatccacaccatatctgcaaagcaactctggaggttccctggctgggctggatgggaacagatgagatttgcctgctcttgaaattagatgctaatggggaacacaaattaggaagagcaagagctgctgctaagaaccaatctagaagtgtctgtgaaatgaaaaaaaaagtttgagtcaaccttaacataattaagttgctctctattttcctccagatcttcttaaaattctacatcaaagtttgagcatggagttttggaaacattttgcattcccttcttgcctaggtttgcatatccctgtggttatataagaactaagcggaagcaaagaatgcaattttagccatttgctaagatacaggctttacataacacctaactgagagatgctatgcagtagttgtattgtctcactatgcctagctgtgctgaaaagcactaggctgtgagctccaatggaggaataatttaagattccaagaaacccctgaagagcagcagcttcaaagtagaagcaaaggctgcatttgcaggcttaactctctaatctcttttgataacaccccagaggcatatcataatatatgggttgtcatggggatggaagaggaaaggatggggttgcagaacatcatccttgggatagaactgagcttttgcatgacctgctcctaagaggacaggcagggtggtgcactgtgtagttaataggggcttgcaagattctgtggatctgtttttgccactttttcccctgagacctcaaagggctatggctccaaaagaagtggattcagcaaaaaagaagggtgtttgtagaggaggtacagaaagggattctggtcgtagtaactgcaacaacgtgagaaacacgtgaaacatcataaaataaagtataataaaatatatatatatttaaaaaatcataaaaccacagaatgtaaaatgatatgcctatgggttgatactttatgagagtagagaagactgtctcaatgctaattcaacaaaggggttgtgaaagaaggtaaatcttgaatcaggaaaacgtgggaaaatactaggtacgggcatgcaaggaaaagggatgaggtttggacaaatggcaggtagtggtggtggcagggcatgttcacatgtggtcccctgtgaggtcagtgaacggcctcggccaattgtgcagggagactgaactgacacagcagcagcgagactgacctgacagggaagcagtcagggggctctggaataaatgatccacttgggaaggtgggccatgaacagaagaaaaggtagattgggggctgggcatggtggttcacgcctgtaatcccagcactttgggaggcagaggtgggcggatcacgaggtcaagagatcaagaccatcctgaccaatatggtgaaaccctatctctactaaaaatacaaaaattagctgggcatgatggcatgcgcctgtagccccagctactcgggaggctgaggcagaagaatcacttgaactcgggaggcagaggttgtggtgagccgagattgcaccactgcacttcagcctggcaacagagtgagactccatctcaaaaaaaaaaaaaaaaaaaaaagaagagaaaagaagataaaagaaaagaaaaggtaggttggggcagtaacccagggatgggtgactcacagtgggaagggaaggagggaagggtggtgaggaagtgctgggaaggtggatgcagcaggacaacacacatgtgtaggagtctctgcagaaagggtgcggaatgctgtctaatttaaccagtaaaccctgaacaccactgtctcctctatcagggactctataatgaaacggccaccatgcagagaagagacagattctggtctaagtagagttgttacctaggagcctggcttgcttcatggtcagcacaataacgctgaccagagttcggttccctcggatgtgggattagacaaagggtatggaaatgaagatcatggcacagcaaaccaagagtggaggagacagggatttgggtctgtatccccaaggaccttcaaagaaacagtcaacaatcacctttctgaaagtagtcaggtacccactgaccacagggatatcgtcagattcccagtgacctccctctggagctcgttcagctctgaaagttagtgatgcaaaagctcttccccctcagccatcacgacgttcattctccagttgcaggttcacagcttttatctccacaggagcagtcctttaaggttgatcgcttagcaatggatgacccgaggtgtataactagttcttatctccaagttcaagtccctgaatagggcctacagtaaatagtcctctggcttgttcagtctgctttaaattctttacaggtcagataccaatatttgtattggttctcataatcacagtagcagtggtcaaaacaggttatttcaggtacaaactgagtcgcgaaaacatacttgactagtagtggagctgtggaagtgtgctctctcccaggtcacgctcaaattatgggcccatggaagaccaccatcagagcggcatgggaggtgtctgagtttgccacccttgccttccctgggttgggcagagagggagtcccaaccaacatcctcacagtcaccctcttctccatccacctggatgggccataccttccaaatccaccatatcctaaaatgtgaaaacaaagcagctccaggacccactgtcttaaccaggtagcatcagtcagctggcttgtctgacagagagattgtgccaatgaatttggccagtgttgtgatcttttaacacagtttataatactagctcacaacccctggctttgcaactcagtcagaggcacctatgagatgtcttaacataaacaaacaaatacaaaattaaaaagtaaaaaaatttttaaaaccctagccaaatgttttggaaatagtttttatttttttagtttatatggaaatattttttaaatgctcacagaattacaaaatctctaaagcttgagtcaaacatgaatttctattttccactcgcaatacacgtggtggatgtctttaggaccaatcttgcagactctaggcactgggtcttgcccatgtttcaatggcctgtgaaatcttttacatgacagagatgacttactacctcttagtaccccttagctgctaagcctttccatcatgcttcccaggagcaagacagtaaactttttctctgacgttagagaagagaaaattgccagcctgaagtcactaggcagtaaccagggcagtgtcagtatttgaacagcctgagaagcttcctcattcattctctttagctccctgggcccccagtctttctcattagaaagaaagagtagttgccaagcctagatcttgaaccagttcgaactgagacttgtgtattccggatatgtgatagagtttaacatgaattctggaagcatgtatgaatatggagaaaccatcccaccaccctgaacacaatgtcatcagctgtgaggctggtacaatgatacctagcttatcgggctgatgtaagtcccagggagaggacaaatgctaaaggcaagctatacccttctgggaaatgccctctctccctgctcattattcgtctggcaaacatctaattcccctttgccatgtggccattcctctggaaagcatctttatgcctttcatgggggattgagttcctccccacccctgctcctacgccctgtattgctagaagtggttcctctaccataaaatctatcacattagggaaaacatttatgtgtacatatgtgtctctctggctctaggtcactctactgaaacatctagaactggaggcaaaacatttcggtttgttcaccatcataccatccgtggctggcacagaggaggcactcagcaaatgaacaaaccaagctgaatgaagaagtaaactttctgaagacaggaagcttactgaagcctggttcatctatatattcccagagtctaacaccacgcttggcactaatgggcacttgatagatgtttatttttgcatgaatggcatgtaaatttattacctaattaaatcatttggaggacaggcagtaagattcagatgtaaatactactggttgcatgcttctgctctgcaagactggcttcttgtgacatactgataatcggtcactgtgaatctggggagtgtccttgttttgtgctcttcccccgaggagggacagatccttctgttagttcaaaagtcggcctattcctaactgccaggcatccaggatgccttctttgcccatctgtctttctgaaaagctagttaaagggctaatctgctcttaattcctttagtgtggtctttgaatgaaatggtttgagtggatttagtctccaaatcaacagaggcagaataagactgtctgggactggcttcagctccgggatcagctctctttgtatcacgtgacttagggcacggatctcagcaggacatctgggatgtctctcaatgaagagatcacacaggggtgttttcgtacctggcctagttgtaattctttgcgtagcttcaggatatactgaagtatttgggaaaataaaagctgcaccccctgcagacaaaaggaaagacaaacatgtgaaggtcttttgttgtggttgtcgatctcaacatcagcgccaaatctacttttccctatgacaacaaagggaagagacctcctcaaacctgccttaacagagctccggagaaacagacaggtgcacctgtcagattctcaagatggaagtgaaacttggagccttggtgtactcctgtgccccgtttgctataaagcgttttgtgttttgattttataacttcttgatgaagccctatctgtgtccccctcaatcccacttcccactgggcaatctcgttttattaaaaaattatatggtacatgttttatttttcaacttgtataaaaacccataatatattttacagagcttttggaaagtagtatcaagcaattataagtatttagcctaagagtatatggattttattaataattaatccacatctctattcaaatgcattttccctctctctcttttgaccaaaactcatgctgttagctgagaaaattcccttttcatagttcagtccatttggaatttgttgtcttgttcattggtttcttccgtgtttaacaatagcaaaatttaatatatttggagcttttttgaaactttcactcaatggttaaagaactcataaataaatgtgaaattatcagaaaatgtgcatagctcaaaggtgtttcctaagaaggggaagtaacttcctctaagttatctgttatttctggccacaaggtcactaataggctgatgtgtgcaaccaaaattattgaaaaagtgtactaccaactcgaagcaggttttttaaaacttcagattaaaaagacaatgtgttgaatatagaagaccatgataaatgagcaatttcattgtaatactcaaaccgggactcactcacattttatattttaaaataaaatggtaaatattgggaaaattgcgtatttctatgtgagggctgatcgtgagttaactggctgacttgcaaggctttctggcacttcccgtctccctccctagcccgagtgattgtggagggtccctgcagctaacagagtggggtgagcagccggtggccatgcttccggaactctctccatcaggaaggagcagatggatgtgaaccaggaacacattcatccacagaaaacccagcctctgctgtgagcggggggcgagggaggaaggttagccaggatgaggcacggtgttaaaccctacttaggctcaggcaaaataaatacataactaagtcaaatgtagaggcaacggttagagatagaaaacaggcatttggttagtgactaatttcatattctccaaaattatagcagaggttccctctgaacaaaagctctcaaaatgttacagaaattccctcctgccttttgcaaacatacaaagtctgtaggaaaacaaatcaaatagcctaaaagtttattggaaaggaaaaagaaaattccaacttatcctagcaaatatttctttaagaataaaaatggaaaaaattaaaggaggttgctaagggcccttttatatcgaacatgcttttagtgtctacagagtcagcacagcgaatatattgggaccaacagaagaagactgtaatccggcaaatgtgagctaagttatggctaaaggcaaattctgcacgtctcctggttaaaaaggaaccctttgataatcaaagtggggtgcttgggaagcgctcagaaaaccaaagggcttcaccttcctttaggctgtggtacattcctaagtatccgaaagtattctgaatcatctacctgcgttctgtcttcctggcacgcgctgactggtttcccatgaaagcatgcaacctgtacgtaagaccctacgctcttgctgggaggcaggggcggggccagcattacctgtgtttctagcatgcattaaccgtggagagttttgtaaggctttatcaacatcatctgaagtcaaatgtggaagaggagctacaaaacaaaacaaaaagcgacatcaaaatgaaaaaaaaaagagagagagagaaagagaattacctttcttacaaaaaaaaaaaaaaaaaaagaaagaaaaagaaagaaagaaaaccgttcccccactcccacactaacatcatgggaagcttataactatttccagcaacctgctacttgttagcatgttaaaacctacatgggggcccgtctttaattcagggaagaagtggttgggatgccaggcaaagcaatggaggagaatttatccacctcactgtctgtcacactacttccttctcaccatgctggacgttgtagaaattaaagcatgcagcaaacattctggattcatgccaacatgccatccctttctgtcaggttaagccgaatcacatgatacaaagtgaaaacttcccttgttctgtgctcaggttagaatataaagtggggcttcatgtagctttagggagaataatccccctaattcctacgaaagagaagccttaatgattctatttcgattcggggtatcatggagacttaactaatgtgtgaccagttaacgcttcctttcccctttgacattccatcttcttggtcgcaggaccctggaggaggcagctgagtgttgaagtgaattttggcttctcctgagagcgctgactacttctcatcaggtgatgtggccagggtgttgctcccctaagtcatcacataccaagcatgtggctccctcggatccccagtgggaactgggcgagggcaggaggatgctgtcgacacacctggttgaaccctctgaagctcaggtcataagaaccatagccacagccatctatccttggaggaagggggagcttactctctctgaggtagtggagatgtgagagaaggatgtcggcgttgtagctgggggtgagcctctggaagtcgtccttggtcatcttgcacagttccttcccatcgatgttctggaataacaagatgttgacgtctggaaggccatattctttcaccgcccactccagccactgccgcacatggtctgtactccatagcgtaggatctgaaaggggtgggaacacattcagtcaattcctgaagccagggatcttcatcttggggtagatccccatccacgtgggatttctgaccagctgccttccacaagcacagcctccagccagcctccctggctacccaggagaacattttgggggaaagacaaaagctgcctcacatccatagatcattgtctttaaagtgaatagttctggaatcttgggattattcacatcacatgcccttgtttttgctcaatctaaagtttcctgtaggcataagattttaaaaattcttttttctcatttatgttcaattttatttatttattttaaaatgagtaagaataagaggaaacttcttttccttagaaaactactggtatatttatatatatttatatggaaataagagtaagccacacatatcaggaaggtgctaattacagatcacaacaacaacaaaaataataataacagtatttatgcaaaatactgaaaaatactgaccacagaatcggaaatgaaatatagatacaccaagactctagcccctcctatgagccagcgttcctcatagagagctgtcagttccagacttttcctgcagggtgtttggttttgcaattaaccagcacctgcaggagtggggttggtgagtggtttttgcattccacagctggccatggcgagcacaaacaccccacaggatgcaggccacgtcgtcacactccagtgctacctatgggacagggagagcagggcccgggggagaaggagcaggtgatctccaacagaaacgccagccgggatgtcctgtggtaaacaccctcagtggtagggtcttcagagtgtggtaaatggggcggctgctcccttgggccccgagccctgagagacacatgggcagggagttggagccctgagttctaatctcaccatttctccactttctggaccttgctgtgggcagctatttctcctttctgtgtctgtcccacctgtaaactaagagcactgatctcagttcccgggacaagcccttaggggtcaggcatgccaggatgttccagtcctcttgaatgaaagtcaggtgtgggagtcacattttagctaatactttcagatccttgtttgtttggtcccactaatattttaggctactcaagaatggagcatgtagtatgctgctgcaatacatttttaggtttgcagaggtaaaccgtaataatagtgagaaacagccagccagtcatacacccagagttctcttcctctccctccttccctcttccttccttcgcttctccctccctttcttcccttcagctacatagaagaaagaaattattgcaggtccagtagaatctacctttcccattccattctcctactgcaaacacctatcctgaagttagtagctagtggttagaagtaaccactatcctgaagttagtacgtgtatcactcctatacatattttaatatttttaccatttaaactacatatattgttttgtgtttttaaagttaacataaacgatatatgatttgctattggcactcaatgttataatttcaagatgtagccaaatgaattcacaaagatatactcaatcattaagcagctcttaggcctcccccatgtgaataatctcaatttatttagtgaatgtcccctgtccatctccatgcatacgcgtgaatgagtccgcattggtccagggcctggggtcctttctggaatcatctggggagactgaaaaactagtgatgcctggtctcccctgggagagtctgcttcaattaggctggagggcagttgggcatcacagttgataacagctcccccaggtgactctaatgagcagccaaggttcagatcatcttccctgggcctcactattccaagcgtggtcctccaaccgcggaagcatcagcatcacctgggagctaattagaaatgctgagtctcaggccccacccagacctgctgaaccagaatctacattttcacatgaaacctggggacacgctggccttggctgagtacctagatacgggatttctgagttacagggcacatccatcttcaacttgaccagctagcattggatgtctaccaatatttaaacacccacattctcacttaaaaatcagtgcacaggccaggcgcggtggctcacgcctgtaatcccagcactttgggaggccgaggcgggtggatcacgaggtcaggagatcgagaccatcctggctaacacagtgaaaccttgtctctactaaaaatacaaaaaaaaattagtcgggcatggtggcgggtgcctgtagtctcagctacttgggaggctgaggcaggaaaatggcatgaacccgggaggtggagcttgcagtgagccaagatcaggccactgcactccagcctgagcgacagagcgagactccatctcaaaaaaaaaaaaaaaaaaaaatcatcagtgcgcagaacctgaaaactaaagggaactctggttttgctacagagagaatatcaacaaaaactccaacggcagtgatgacagaaaagtgtacatatttatttgtcatccaaacacttggaaacatgttgttagtctgtgaaaactgaatgtagatatggaaggttaatgttatccagttcactgaagttcagatgactcttcgtcattggctgagaatttggctttcagagataaaatgtttcttttttcatgacatgtcagaattcctctttctacaaaaatggatcatactgaggtcttagggcaagttctctttacctttggttctgtgcagaggatagtttgttcagccctcacagagagaagaccccccatcctacccaagtcattccctgtaagttccatcctttgatgttagcgaaacccacctttttgttttgttttgctttgcttttaacaaaatgggaggactattttttttttaatgtaacaactgtacttcctagaaataagttcattctgggaacagactttcttctctaaatggtggaaccggatattctcaaaatgacacataaacatattgtctgaaagccactaggttcgtgttaaaatggtgaaaggagaagtttaatctctctattatcccttggtgtgccccttaattggtttcgctcatcaagacaagggttatcctggcccattcagttttcctttaagggaatcaggtgcaagaccccagagacaaagtcctcaacctgtattgtacttatctctacaagtctcactttgagttggtaaaaggctgttctggagttccggagttctgccaatatgagtataaattactacagcctttctgatgaacaacacaataatacaacaatacaacacaacaatacaatcaaacgtctttaaatatgtgcagattccctggcttaaaaattccatttctagaaatttatcctaaggaaataatagaggatgtgcgcaatgatttattgtcaaggatgttctttgtagtgttgtttataatagcaaaacattggaaacaccctaaatgtccagcaaaagagaagcagttttgtaatgcatttaggaatgttcctgtgatatttagagactaaaaattacactgttgaaatatatttattgatatgataaaatgttcaaagtagattgcattttaaagtttcaaaatattattatgatatcattgtattttgcaaagatatataaatatctgcacagaaagaaattcagagggagatacagcaaaacgtgaactgttgtcactgagggaaaggagatggggaattttagatttgtcattttcactaaactatattttctcatttttctataataaatatggaatacttgggttacaaattatttatacaaaatgtattctctatttttcaaagccaaaacatggtcttacaaaaggtatatatatatttaatgtatattatatgtatactatatatcacctatatataatatatgtgaaagtatttttataaaatactttaaatactttataaaaagtattttttaaaagtataaaaaataaaagtaaaaaaacaaaaagaaaagttaaaaaaatgaaactatgcaaagcattttataaaaagtataaaaaataaaactactaaaatactttataaaaatatttttataaaataataaaatatataatatatatagaatatatacttacatatatgctatatatactacctatatatagtatatatgtgaaagtatttttataaaattgctgtcaagagtataaaaagttaagtttcagtttcttttatattttgttaatatagactgcttcatctgaaaagagtaaaattacatgaagtcagaacactcccacatccttttagcatttgatctccacacctctgccctataaatttctaagcaaacaatggtgaaaacaaaacatggccactcggtagaagaaatgagggcattccttttctcctgagcactcgcaccactctcccagacccactccggaggtgttgcaatagaggacagtttgcaggggaaaaacccagattccccagcatgaagcacacagtcctttgttccatgggtgtcattcccaaccattccccctccaccctacatttcctgagccaatgcctccatgcctgtgccacatgccacccacagcgtgaaggactagcaccttcttgtgccctcacctacactcacgacctcctttgggcatctgtcctagatgttctcacagaggaaacacttaacaaatctctgggcagtgaagtgataacaagactgaagacctagtctctgctcacactgaactccacctccactactttggccaggcaatgatgctgcagctgtagatgatggtttttagagttcaggtcagtgcactgggtccaggctgtcaggttttggtcctaaccttttaactccatgaagagccccagtagtctctctagtctcctccacactccatggtatctcagcaaagctttatggcttctgtcacaccaggaatcaaagaaaggggctcatgagttcctatgagattcagcaggcctgtcttcctcctttcttgaccccaaccacacatgtgtaggaggaaggggaggggactacagcataagccccagccgaggcatcacctttgcctatgtttaggtgcgaccttctgccctaggtaggaacacctcttgtctccaggtagcagtgtgtttggaacctgtcatttaattttataactggacctcatttttctcttctgtaaaacaatgtggagaatttcaggacctgagaaatgactcgaataggataagaactaagatagatttaattcaagtaaaagtcattaagcattatgcatatggctatatgcaccagtactatggagattccaaagtgtccaagaccaagagaaacactaaggacccactgagagaggcagcttatgaccacaaccacaaagcagaactaagtctctgtgatcaggctgggcgtggtggctcatacctgtaatcccagcactttgggaggccaaggcgggtggatcacctgaggtgaagggtttgagaccagcctgaccaacatggagaaacctcatctctactaaaaatacaaaattagccgggtgtggtggcgcatgcctgtaatgccagctactcaggaggctgaggcaggagaattgcttgaatccaggaggcagaggttgcgataagccgagattgcgccattgcactccagaagcctgggcaacaagagcgaaactccgtctcataaaaaaaaaaaaaaaaaaaaaaagactccgtgatccaaggaggaagtggaagtgcagagaggtagcaccaaccaggaaaaatgggaaaggcttaccaggagagtgaacttggattaacagcgaggattttgacagaagtagagagaagctctttggtttaggggaaccacttagcccagcctcatccgacatgggcatgaaatatctgacatgtttaagaaaaagggagaaatttggtgtggctgcagtggaggatttcagagagagcacagcaacatacgaggatggggatgaaagctgggctcagatcaacaaggtccttgagtcttgctaacaaggttggattttcatttttagagatttcagagtaattgaaaatttctaagaaatttttaaaaatcttaaataacaccaatcacagaaaacttggtgatgaaaataaaaggctttattgggaatccaaatacccacattgggattcttattcaaccatttactggacgtaaacgtcaacctctctggaatttgttttatatttttctgtgggtaattaaatgaaatgttaggggaatagaaaagtaaatgagataatggatgtgaaagcactttgccaacaataacatactgcaaaaaaagaatgcatccacacactcgattttgcattgcaaactctgctaaaatggaataagaacaaaatctgttatcacaggggcagcctcctccttaagacacaaaagtccaatttataattttattttaagaaacttttggagatgcttctgtcagatgaatcataagccattgaagataagttgttcattttcagccttccattccaattgttttgaaaacatctgtgtcatcattctacatgtcatggacaccaaaatggtaaactgtcatggcacaggctaaacagaagccatcactctctgaagcctcttatttgtatcttaagttacatggttattatgaaatctactttggtaaattggaatttaaaaaacaaataaaagtaaaccattacacacagagttctggagttgtactgttaatgtactctgtatgtggagtgggagtgggggtataagcagtgggagggagggaggaaggctgacatttaaaaaaaatatttccatgaaacaggattctgacctagtagagttcccctgttgccaggaaaatattgagtagatatttaaatcaggcaaaggggcactgcatcgccaaagacaaactgtgcctttgtgaaacaaaatgcctcacacaggcaaacatcttctttcagaggcccctctagagaaatgaataaagtaagattaaataaaagccaaactggtgataatgaaagtcctgaatgttatttttcttaaataatatcaacgtaaaatattggcttcccaaaagaaaaaaattactcttggttatgaaaaaaacatcaaaaaataaaaactaaaatgtacctctaagccatatcacaagcctagtgaggtgtttgtttataaatccaggccctgggcaagtcagccaatctgctgtccaagacactcataagcctgcaaaaataagatttaacatcttgcatcctcaggaggacagaagttacatttataaagcaggcccaatagagagaactggcttaaatttgagcaatgattcactccatcacaaatggaaatttgatctcaaataaagagcctacctcaagactgtttctgagccttttaaatttctaacttatatgtagagttcatttattgttttggtattgatttctaattttattgcacgttggccagtgaatagagtctgtatgaaattaacattttattttattttatttttttgagatagtgtctcgctctgtcacctaggctggagagcagtggcatgatctgggctcactgcaacctctgcctcccaggttcaactgcctcagcctcccgaataggtgggattacaggcacccaccaccatcgtggctaatttttgtatttttaatagagatggggtttcaccatgttgtccaggctgatctggaactcctgaccttaggtgatccacccacctcggcctcccaaagtgctgggattgcaggcgtgagccaccatgcccagctgaaattagctttttaaaaagttccggtttgttactcttttggcggcctagtgcatggtcagtttttataaatgttccttgattgcttaagaaatgcatattctctaatttgggagtacagagttctagaaaaaaaactcttggtaaggtgtatttaattttaatgtcactgacctatcaattactgagaaatgcaaattaaaatatctcactaaattggacttgactatttctttttgcagttcattacatatttcaaggctatgttattaggtacatgtaagtttatcattattatatatttgtcatgaatttagccttttttcactatgtaatgaccctcaattatctccagttatgctttctgcctgaaagtatatttagtctgctttctatttctatttttgtcagctttttaaaaattcaattttcactagcgtatcttattctgtcaactctcaatctttgtttgtgcaagatttttttgtaaacaacccataactgattgtggagtattttttagtctagtctatcactctctgtctttaatggcaaatttggtctatctacacttattatcactgatctatctgatttttaccatcttattttgtgctttatgttaaactttcttagtccattctctatttctccttgccaagtgtctaatcagattgatctacttttcttcattcacttttttttctttgtttctgtattggttttgctctttgacattctagttctctttcctgttaatctttaaacaaaatctaagtttaattaccagtaatttagaaagcttatacttgaatcatccatctctgattttacatgacaatgttccctcatatttttactccactgaattttctactccctacttagggaggctgtggttgtcattttacagccatttctttctagatctaccctcaccttaatcaatttcattgctcccatttccttcctgtatctcactcccttcttctaggatccattttttaaattaaatcttttgttattatctgaagtgaggttcaattagcaacaaactctctttttaactccttcttttatgttcttccttaatatttaaaaagtttatttattttatactctttatccaatactttaattatttaaccttctgcttaatcatgttcattgtttctgttaaatcttggttgggggagatctctcttcagctatttttttgtaatttgcgggtggcagagtcatctttagcgggtctctatctgcaggaattctgtacagcgtaggttgaagacatgtctctccatgaagatttcgtatttacttctgccaggtttcccagattatcactagcccatgaccatttttctgtattaatttctcagccttagagttcctggcacacactgttgtgtgtatggggtggggactcgggtaatgacaggctcagttccaattctctgctttgtggaagctcaagatttcattccttgcccctagttgacctttaaaacccaaatctctgcattatagcaacctaggacaaccaggtgtcaacataagaatgtgctgctctgctctattctcacttttttccttattttagtccctaaggagttcattgcctttcttcccagttcagctgtgcatttaaaaggatgttaaactccatgcagcaattccaggtgttttgcaaaaggaatgtttctcaggtccttttatagtaacctctctattttactagaaccaagagccctctctgcatactttttacctatttactttgaatagttttcatttttaatgcagccatcatcctaactcatgttatgctttacttcattcatttattaattaatcaattgtcaaaaattacttatatgaattgtataatcctctatgaaagattcaaaaatggcaagaaagagtgcctgtcctctacttgtttgagaatctacaattctgtgtattttatttaaaaatacatgactaaattatttttgttaggctctaaacatagctttgtcattctgacacactgatttatttctctggatgaaaccattctcaagtaatcatcttgtttttggataatgatcgttattgttctttgttttcttttgttgttgttgcctcctgttattccatgacaacattgtgtgtgctcatcatgttttagaaatgcaatggcttgttccacataaaggtttctccctgcctgggttttctttctttgtcttctctttaaatgttgctatccccagagtttcatccttggtctacccctctcctctctccatatgtatctttgggcattcttatttgctctcatgtttgaactataacatgcatgctgtattattttcctagggctgccgtaaccaagtaccacaaaatgtgtggcttagaaacaacagaaattcatcgtctcatagttctggaggatcaaagtctgaaatcaaggtatcagcaaggccttgctccatccgagactgtggataaaatctgtccttggctcttctagcttctggtgctgtccagcaattgaatgttccattgcttgcagttgcatcagtccaacctctgcctgtcttcacatggagttctccctctgtgtttccatatcatcttccctctgtgtgtgtctatgtccaaatttctcctttgtgtaaggacaccagtcattttattaggctcaccctaatgacctcatcttaacttgattaaatctgcaaaacctctatttccacataaggtcacattctaaggaactgggggttaggacttcagcatatcttgtgagggaggcacaattttttaacctgtaacaggcagctgtttctgccagtctatatcttgagtccccagggcactctcacagatgccagacccaaatataaacagaagaactgcactttttatcccaggtactgtttaagcatgtcacacatattgctatatttaatccatatagcaccacatgaagtaggaattattatcatccatattttggtgatgaaaaacctgagaaacagcaagattaagtagcttcccagatcccacagttagtacatggcagagtttagaactcaagtgctgtgactcccgatcaaggactttccatcctgagctctaggcccaccacactgcctgacaggtgtcccagaagcatcttaaacacaggatgaaccaaactgaaatcacctattttaaacattttttttttgtatattcattaacacctacccagctgctcatgctaaatctaagctgtcttcaattccattcttctctttgactttcaagaaaaacagataacatcattagcactgtagaaatgtaaaaattagccctgggcaacacagtagattattttacaaaattccctctccacctcctttgtttacttaagtcttatttgaaaaggctgttgcagaatgtctacaacaatttaacaaacacattctctcatcccattcctgtgttctcccctgggtatttttgtcagcacagcttaggaagaagaacccagactgtggagtcagaaagaactgggttcgaatcctggctcttcaaatgattggctgtgacatatttggcaactctcttagcgttcctagttttagtttctttactgtcgagtgagaatgataatgagtacctacatcatagggtggtcgcatgatttaaatgagataatgccttttctacaaagtgcatgtccaagtgcctgacaacagtgcatatcaatagatagtagctgtcgttgctttttagaaaaatgacttgattttagcctcacatttaacccaatggtggtttcctcaaccgctattcagctgataactttaaaatacacataataaactttgatgttagcatttctattttagtgggttttgttatttagttgtttgagcatagcaggaatttaaacagaagattaaagaagcatgtcccatcatatcgacagagtggaagagatcctcgggtgtgttcagggacgtaacaaagaaagatgaagacacaagtcatttcaccagcaggttctgggcctgagaataggctctggtctcacccagttgtgcaagtgttcccgggaaagtcatttcacctctctcagtcttggttttctcatgtttaaaggaagactgaacttagaccaccaagaatcctgcaacccctgcgagtctgcgattcctgctagttagatctagattactgttaacttgataaatcacatttactctcctccacacagaatccaagtgctggctgtgttgtctggcgattgagaacacaaaagacatgatcatcacctcactaaacttacaatctaatagaacagacaggcttataaataactcacgctaagaggattggaaacataatatatcagccatcagggcttggtcggagggtatgttctattacttgttattcactggctttcaaagcccagtgggggaatgtcaatatttagggaggatcatgtggaaactatgcagtcctctaacactctgagaactcaagatcccttctttacatgaaatcagactgccaaagactcatgctgggtgtctgtcctctacctgtgctgagctattctctaatgtaactcagcgctcacagaagatgtcacaagaaataagctgttgaaatgcagtgctgcaactgtggcaggaagacggtcgatggtcaggtctatggccccagtggccccaaaagggatccttcttttaggattctacactatgataaacattgccttccctgtgaaacttcttttttgaaaggaaaaattatttccccaaataactcttttcattttggctgccaggaagctcaaagccatactagaaacttaagtacagcatcttgggcaagcttgtggtcaaaatggctgcattcttccctcacatgctcttggcttctcatttgtatttttaactgccttagcactgattcctaatttccatttgataagtcaattgggtataagcccatcagtagtttagttcacacggcacctcaaatcctttgcagaatatccacatttaagtaagtatatacatgcatttgagaatacaatatgaaacaaaataaagtatgataacaaaataattggtaagatgtcataagaggagtgattaatttgccagaggatcaagcatggctcccttgacagggcagattttgaagatgtctggaagaatgagcaagagcattccagagagggaaccgcagggacaaggacaccgggtggtgaaaatgcagcgcgtgagttggggatgtggcagaggaaaacggcagaggctgcaaagggctttcgaaatcacatcatcgtgggtataaatgaagctgttcttgattcgtcctgtcatagcaatctccattcctcacatgctctgaaatactggtctgagtcattcatttgagctctcaatcacaccttctcctgtctgtcaaaaactacttaccccacatgggtgggtcttagctacttctgacagccttcggtcatctcctcagtgattaagagtaatgggaactccatgaacactttctaacggaatagaaaggtcctagcacaggggtctgagtaagacacaagtcatgtagcttcagccacacatgtttggtgggcaagaaaaggtgattttaaatctcattagagcttttattcacggtgaatggaacacagtaagagtttaatgaatgaattaataatgaagaaagtgaagagatacagtgaagagaagaatgtggctactcttatctctgagattactgattattgcaagggtctatgctgaaagtgaattattttaaaaatagaagcagaggcatttgaaaaactcaacactttagcacctattttaaggaattaaaacagaaaaagaggccaggcccggtggctcacgcctgtaatcccagcactttgggtgaccgaggtgggtggatcatctgaggtcaggagtttgagaccagccttgccaacatggtgaaaccccgtctctactacaaatacaaaaattagctggctgtggtggcaggcgcctgagatcccagctactcaggaggctgaggcaggagaattgcttgaacccaggagacagaggttgcagtaagccgtgaccgcgccattgcactccagcctgggcaacagagcgaggctccatctcaaaataaataaataaataaaaaataataataaaaaaacagaaaaagagaaatctttcaaaatgctataagctgctaaagcgagaggtcctattgcattttggtcagcattttgcaacttttaagaagtgaatggagcctgtgccttcctctttgttagccacttggttagcacatctccatgttcacagccaacacctaaagagtaacagtaactactgcaatgagtgattcttcatttttttttggaatgttaatgtgatactgttaatcatttctatctttcctttttgtctacttgccttttctaaaagtgataaaccatatctttattaaaaataattcaagtctattaaagtaaaatttatatcttctatctagattagaacttttcaaccttattgtacatgaaaattacatacacaataagcatgttaataatgtaaaatttccaaccccacacccaggtttggaacatttggaagtgtgtgtgtgtgtgtgtgtgtgtgtgtgtgtctgggaaagggtctcactctggcttcctggtgggagtgaagtggtgcaatcatggttcactgcagcctcaaacttctgggctcaaagaatcctcccgcctcagtctcccaagtagctgggactacaggaaccaccactacacctggctaatgttaaaattttttgtagaaatggggtcccactatgttgtccaggctggtcttgaactccttggcctcccaaagtgctgggattacaggtgtaagccactgtgactggcaggaaatgtgtatttttaatcataaattttccaggtaatcttgatacaagtggttctgaccatactttgaaaaacactttctaggccaggcgtggtggttcatgcctgtaatcccagcactttgggaggccgaggtgggcggatcacctgaggtcaggagtttgagaccagcctggcaaacatggcgaaaccccatctctactaaaaatacaaaaattagcctggcgtggtggcgggcgcctgtaatcccagctactcaggaggctgaggcaggagaatcacttgaacctgggaggcagaggttgcagtgagctgagatcctgccattgcaattcagtctggggaacaagagcgagactttgtctcaaaaaaaaaaaaaaaaaaaaaaagaaagaaagaaaaagaaaaacactttctagtcaacctccaaattaagctcggccaaaaaagagccatgtaaccagcatgggggatgtcacacttgtcaggcccctcttattacaactggtttcactgaatgacacttgggtttacgacagtgtaagagactgccctgccctatgagagatcctcctagatttacagatactcgcaccaaatacatagataaaaaccagagatgggaattatggcctaaccagtaccctttgggaaggcacaatcaacagtcttgccagaacaacaggcacaaaccagggctgcccagaatgcctggtggcgctactggttgaatgctttgctcatgactccccttatcttccttaggacaaacagaggaacacatcttcctccagactcagaattaatagctggaccatcttttcacatttgctttctttttatcctgtaggcactgaattatccctttcatactgcctgatgatacctcgaagccaaataacacctaccttttgcaattctgcaatatttaaatgttgcaattaaaaatacacatacacacacacacacgtgcgtgtaaacctcactcctggttttactctctctgttcaatttttactttagtccattctccacattcctttatttttaaaaagtggattctaccgtgctctttcatatgtatctatgtgagctttcttaaatctgttctgaaataggaggcagtgtaaatatatcaagtgacagtctacatttatccttcagggacattttctagttgacactttcttatgggcttttttttgacactttttttatgggcttctttattaactcaagatcatgagtatcaaaaccagggttgagggaatcgcttctcaaaagtgggttccaggtaccagaacccaatctgaacacggacaaagccccccagctcctctgtggttttatctctcagtctccgtacagtacaaatttcctcatcagtgtttattagggccactgctatctctagtgtgtaaacatcggcatgtattgatgatggtacaaatgtttaggaataactgatggtttttttttttttcactcagctatccgtgtgatttgcattagtgccaagcaatgtctctaagtagtaaggtctatgtgaaccactcaggaccaggtctggagaattctttttgcacacatggggtactccgtgccccaaatctgccttagtgaggtgcctggataccatggggatggatacagcagctggtacagctgcctgaggtcctgcaacctcatggccacattggaaaattgtccagattgtgcaatgaagctgtgtgtgtgtgtgcgtgtgtgtgtgtgtgtgttcatctctgtgtgtgtatgagcacacatacatgaagcttgaccaataactgaaagactcacaacttgcaaaatcagccacaactagctctcttacaaacactattaactgaataactgcctacactggcgtgaagcaactgaaggagggaagagctgaagagaagagtactttgctccaaagaaaggaaacagccttcacatcaaagcttactataagccaatttgcagagctatccttgcatccatccagctaatatttgatgagcagctactatgtataaaaaatcctgggtgctctgacttcagttgattctctgttctcttccccacacaaatatctctcttattttctaaatactttccttagtgtagaaagactcaagtctggccctactgaaaaggatatttatgacatcaaagcatattgatggcctcatggaaatacagcctcaccagttagaagatggtaccaggcattacctcttacatctgtgattcaatgaggaaccaagcaaggaatcttcagtgcaggccccctcagatggattctctcatctttgagatctaaacactttgttttgtctcctttgaagaaattacattcttaaggaggagggcaaagggtgagatgggttagggggcttcctttgggtgtctacttcactttgttcatgcccagagagtgtctgggcaacacaccactgccctcctgcctctcctccaggcacatcctagccttcgagtttttcttatgtgccacacatctggagtgggcacctgggacatttgtgtttctatttttcccatccaacaggaacagccccctgttctgaggcacagcagcaagtgaggcagtctcaggcattcaggtgcattgtcaagatcaaaccaaatgcatggcctctgtacctgtcaactgcctttcagtaaatactaaggacggttttctccctttcgtaatctaccatcagtgtctcctgtaagtcttaaaaaatgctttgaaatcaggcacaaccccaaaggatggtccctttcacaccccactgcatcgaaccagctttacgtgtttgctgaaagtcacatggtgacagatctaagctgaaacctgggattcaaatccaggccagatgttttgcaaagtaccctgcactcctgaactcttctgtctagaaggtgacagaagcccactgggcatgatccaactcaggtaaagggaaagtcacaccatggagggaatctaacctgtttgccatcacacttcgcagatattaatttaggtgaccccaggagcaagggagaattgagtttgtgcagatttcacccatgcatgcccttggctactttgccaacaaggagtaacttgtacagtgcagctcagtggtgaggtgtccgttcatccattctccacctcccttaatattcactgagcacctcccacttaccaggcactgcaactggccctggagatagggcctttgtggggcttatgttccattcagggaagaggataataagaaaactttttatttttttatttttattattttgagacggagtcttgctcttgtcgcccaggctggagtgcaatggcacaattttggctcactgcaacctctgcctctctggttcaagcgattctcctgcctcagcctcccaaagtgctgggattacaggtgtgagccaccatggctggccagtaagaaaacttttacataaacatgcaatataatggcagaagggaatgaatgaaatcaagaaaaatcaggccaacaggagactggcagtcacaggtggagacgagagcaattccagacggaagtgctcaggactggcctccctgaggccatgacattggcacggatacttggtgaaggaaaatgatatggaactacctggaattaagggtttcaggctgagctgacgccaaattcaaatccctgaggcaggaccgcagggtgaccagatggctgaaacaagtaacaggagggaacccacagaaattgctgtaagcagctgagatttaatccaatgccaacaggcagagactaaaggagtaaggcagacctgcctgagtcctaacttggcctcttattagcctaatgcccttggaaaagttggtggacctctctgaacttcatcttcctcatcagggaaatcatgagaaagatgtccatttgcaaagattgcttgagatcacgtttctaaagcatttatccaaatgcctcctgtagggtaaaggttcactgactggtgactgttgctgttgttcttatatttctggctttaggtagcatgtatcctctgaggagctttaagtcattttttctattacctttagtttggctaaataaataagttcttgtcacgtctttcaagttcaagagctattcctttgggttggttttgaattatgtttgtggtaaagagttactctggttattagaatctgtattacaggccagtgatagctggaattttagatgcttaagggaacacgtaagacagccatataatatatggctcccacatgtttatttttccagataagagaattttaaaaacaaacaagtctatcatctatcataaatagtacctcatgaaggacaggatatttggaacaataatctccaagaagtggcaattcctccctagaaaggtcacctttcatagacatatacacacgtgtgcatatgtgtgtgcacacaagcaaggctgcatgtttgcctggacatcctctttctctctgtctctctccatacgtagtgtgtgtgtgtgtgtgtgtgtgtgtgtgtgtgtgtgtgtatttttctctatgtggcaaaataaagagctggggctacatactgctgtctcacatattttttaaatatttgtatttttaaatacaggtgtatttttcttgctttgctgtcgatccgtgaacatgtcctcatgcatagacctctgccagctcccatttacaagccctgctctggacaaaggagatgtgatcaatgccacaggtgggggagaagagctccctgaggctcagcctagccttggggaagttgcgatctgccgagggcagtgaagctgtgggcacctgacctgctggcacgataactctgcgctcgttcgtggtcatgtttgggggtggcatgtgcttctcctccatgtagctgccgtagttcatcccaacggtgtctgggctgcccaccatcttcccgcctttggccacactgcattcatcaggagagttcctggaggagaagaaatattcttccattataacagcaatcaaagagcatgtctccatcgacttctcacaatacacagagagaaccaaagaagggcaaggcggaagagactgggggagaaaggacaagtgtgaaaagccaaatacaggcggggtgccgtggctcatgcctgtagtcccaacactttgggatgccgaggtgggcggatcatgaggtcaagagatccagaccatcctggccaacatggtgaaaccccgtctctactaaaaatacaaaaattagctgggcatgcctgtagtcccagctactcaggaggctgaggcaggaaaattgcttgaatccgggaggtggaggttgcagtgagctgagatcatgccactgcactccagactggcgacagagtaagattccatctcaaaacaaaaaagaaaagaaaagaaaagaaatgccgaaaacaggccttgccttctgtcctcccgaaatgcatattttgaagccctaactcccaatgtgatgatattaggagagagagcctttgggaggtaatttcagtttgatgaggtcatgagggtagagtcccacgatgggattagtgcccttattagaaaagaaagagaccagagctcgagctctctctctctctctctctctctctctctctctctctgccatgtaagggcagagcaagaaggtggccaggccatctgcaacccaaggacagagacctcaccagagactggccctgctggtgtctgattttagacttccaacctccagaagtatgcaagctcgagtcccattgtttcagccagccagtctgtggggctctgtgaaggcagcctgcacaggctaggacagtgcccatactggctagatgcacagaacacgcacaagggaggcggaactaccacctggcttctgtttcttaagcagctcctcctgaaactgtcatgtcaaaactccatctgtgacaactgattggggacacttgcagggaacagtgaactgctctttgttctcgcggtgtgacagcaaacaggcagagtagacagatgctgtggggcggcaccagggacactcgctgctcagtgaggtttatcctggaacgacgttccttctcaaaacctcagaatgaaatcctcctgctcaatttcaaatccctgcagccaatctttacatatggagctttgaagactcacagtgttccaggcttaggtgtagacaggaagggcagggaagggtgaggactgacgctaggggaggcctcatggggagtggactccagcagtcctagaggacccttgggaaagggatagggaaggaactgtgtggatgcagagaggggtcagctactgactactgaccgtgggcaacaggtcacagggctgctgttagtaaggcagtcactgtcatttggataaagtcaaacctacctttctggaaaaagaaaaggaaaacattttaaacagtgagttgtgaaagctacaggacattggtgaaatcgcatctgatagggaaatgctaaaaagaaaatccagcttagggccaggagtggtggctcacacctgtaatcccagcattttgggaggccgaggtgggcagatcacctgaggtcaggagttcaagaccagcctgatcaacatggagaaacccagtctttactaaaaatacaaaattagctgggcaagtggtggtgcatgcctttaatctcagctactcgggaggctgaggcaggagaatcccttgaacctgggaggttgaggtcgtggtgagctgagatggcgccattgcactccagcctgggcaacatgagtgaaactccatcaaaaaaagaagaaaggaaagaaagaaagaaagagagagagaaagagagagaaagaaaagagagagaaaatccagcttaagcagaaaacagaaaatacatgtcagtgccttcttagatggttaacacgtagatggtaaacccagggtcactgtagctgagaagtattaatatttagggtctgttgtctaaggcggatttccagaaatgcctctcaggctctatccaatgcatacatttttttcatattccttggaatctgggaaccttcgctttctctagattttagatttctatcccagtgtttctggttgtgggatccacgccaatgaagcctcatttatctcctccacttcttgttagttggagttctgcagagaacttggacaatcaaaaaactatgggcttggcatggatgtgaacttcaagtctaaggaggtcaaaaccatctgaggcaggagcgcactttctgagtggggtgagatggagaaggtcattccacacctgaaagccatagctgggatgtggacaggaagggaaagtgtttgttcagcatgtgggaacttgaaaatataggtttgttctcagcatcacttacaaatgtgtctgaagcctatggagggatcttaggtgttggcagtgaagagggtacactgccatctgcggatggaggttacagtcagggtcacgcaggactcaggccctaacatgggcctggaatgcacagccctgcctgatggcatcctcacagctgtgctaacatgaaggaaattttaaaataataatggtctgagttcccatgaagtagatcctgaatatttccaccgctgcctacacatgcattatttcctcttgatgctatttttcctggcttcacacatttatctctaaaagacccatcctaatatgaaaacacagagtgtcttcacttagactgagtttcctattcctctggaaaattccatcagttgagtagagtgtatatgttttggtatatttgtctcaaggagagaagttaccagggaagagaagttagagggattaggttctttaggaaaaagactttgcccagatgatgtgagtaactcaagtaacaactataaaatctagacaacctttgttcagattcaatcattcactcatccatttagacagctgttatcaagtgccggccgtataccaggtcccatcaattctttcttctccaacaacgcagttaacaatttgaaaagtaaaagatcaaagagatgtataaaattatagaaacaggccaggtgtggtgactcacgcctgtaatcccagcactttgggaggccgagctgggcggatcacctgaggtcgggagtttgagaccagcctgaccaacatggaaaaaccctgtctctacttaaaaaaaaaaattagccgggcgtggtggtgcatgcccgtaatcccagctactcgggaggctgaggcaggagaatcgcttgaaccagggaggcggaggttgcggtgagccaagaccacgccattgcaccccagcctgggcaacaagagcaagactccatgtcaaaaaaaaaaagaattatagaaacaggggacattgaggattttgaacccttcagaccaacccctttttcattttcttttagttctttctagtttaattttcatatccgaggacaagaactctaggcatagatcacaagagtttctctgtgacattaaagtagatccttcaggctggttgcggcagctcatgcctgtaatctcagcactttgggaggctgaggcaggcagatcacttgaggctaagtgttcgagaccagcctggcctcccaagtagctggcattacaggcgcctgccaccacgcctggctgatttttgtatttttagtagagacggggtttcaccatgttggccaggctggtctcgaactcctgacctaaggtgatccttctgccttggcttcccaaggtgctgggattacaggcgtgagccacttcacccaggtttctcttgcaaattttaacagcaaaagagtagccttaacatgtttgggatctgttttgggagcttaatagttatcagtcttcaccacagcgaactgtgttgctggcattgtctccactttccagaggtgtgaactgagtactcaaaacacaaggggctggctccaggactcacagccaggaggaggtagaatgagacttcagtgcgggtggcccgaactctccatccctgcttcttaaccctgaacagaatgactccacaaagtaaaggcaagacaatgtcttttcaaaggtaactagatcttcatttcaggaaggcatcagggactccctgacccatacactactctggtttaaggtgtacactaaagcactcatcctgacatactctcctaccctgggactgttcattccctgaaaagcatgtgcatgacacaaacagggcacatatacaagatgcaaataagaaagaggagtgattcctggagaagaaaagaattttcagagatatctgctttacttaagaaaaggacgccaggcacagtggctcacgcatataatcccagcattttgggaggccaagataggtgaattgttttagctcaggagttcaagaccagcctggacaacatgaaaaatgtgtttacaaaaaatacaaaaattagtcgggcatggtgtgcacctgtagtcccagctactcaggaggctcaggtgggaggatcacctgagcctggggaggttgagactgcagtgagctgagatcatgctactgcactgcagcctggacaacagagcaaaaccgtgtctcaaaaaaaaaacaaaagagagaaaaaaagaaaaggaaattttatcacaattcagagaactgaaaagtgttcatttgaaagtctcactataaatacatttctagctctgtgcccaagaaaagatccacactgcacaaatgtgtgtcttgattactccactgcaaccccaccttcaccaggcattccgaggctcacacatcgccgggaaaaagttcccgcaaacagcttggtatgtcacctgcaccaagcgctgcccagcatagaggaccacgtgttctccattctcacatgataaggatttggacgttcaatgcattgttttattgtgcacatgacaaagagtatgctgtgcagggaatgaacagtcctgaagtaggacagtgtgtcaggatgagtgctgcaatgtacactttaaaccagagtagtgtatgggtcagggagtccctgatgccttcctgaaatgaagactagttaccttttaaacatacacatacttttaaacatacacatacttgcatatgtgtgttgcagcagttcctgagaatattctcaggctattcagcaggtgcctgtcaaacagataatcatttagtaaatattaaatgtatctgtctttttgtttggggtggaaatttctttattgcaaataagcgtggttcaagatattgctctcacagactcctttgaggacaaacaaaaatcattttgtctttttatttaatttaaatagttttgggggaacaggtggtgtctggttacacgaataagttctttagtggtgatttctgagattttgttgcacccatcacccaagcagtaaacactgtacccagtgtgcaatcttttctccctcacccactcccatgcttcccccagagtccccaaagtccactgtatcattcttatgcttttgtgtcctcatagcttagcttctagttataagtgagaacacacaatatttggttttccattcctgagttacttcggttagaataatggtctccaactccatccaagttgctgcaaatgccattttcttccttttcatgggtgcatagtattccatggtgtgtgtgtgtatatacacacacgcatatatacacatatacccacacatatacatatgtatatatgtacatatacacatatatgtatatctacatatgcacacatatacatatataatatgtacacatatacatatatatgtacacatatacacatgtacatacgcacatataaacatgtgtgtatacatgtatacacgtgtacacatgtacatatacacatatgtgtatatacatgtatgcacatgtacatatatacatatgtgtatatacatgtatgcacatgtacatatatacatatgtgtatatgtacatgtatacacatgtacatatatacatatgtgtatatgtacatgtatacacatgtacatatatacatatgtgtatatatacatgtatacacatgtacatatatacatatatgtgtatatatgtatatatgtgtgtatacatgtatatgtgtgtgcatatatgtctatatatatgtgtgtatatatatatacacacacacacacacaccacattttctttatccactcattggttgatgggcatttaggctggttccacatttttgcaattgcgaattgtgctgctataaacatgcatgcgcaagtgtctttttcatttcctctgggtagataaccagtggtgggattgctggatcaaatggtagttttacttctaattttccatactgttttccacagtggttgtactagttccatagtggttgtactagtttccatgctgttttccatagtggttgtactagtttacattcccattggcagtgtaaaagtgttcccttttcaccatatccatgccaacatctattttttttttatttttaatgatggccattcttgcaggagtaaaatggtatcaccctgtggtcttgatttgcatttccctgataacaagtgatgttgagtgttttttcatgtttgttggccatttgtatttcttcttttgagaattgtctattcatgtccttaacccattttttgatgaaattatttatttttttcttgctgatttgtttgagttgtcgattctggatattagtcctttgtcaaatgcatagtttgcaaatattttcttccactctgtgggttgtctgtttgctgattatttcttttgctgtgaagaaagtttttggtttaactaagtcccatctatttatctttgtttttgttgcatttgcttttggattcttggtcatgaactgttattctcaaatttacattttcagttccaggttctatttgtcacccacagacattagtcttgacagtcctatgcaatatgtggcatcaacaagagtaaacaggagctgggaagacagatacttccctctgctcacagcagcagaaattccacattagccagggggccccaagaggtggggggctggttcagaattctgagaaagaactgaacaatagcccaatggctgggatattaaaaagccagccataacacctcacaactccctagcaacacccttggggccacacagcctcaaactcctgagctcaagcaatcctccttggttcagcctccctatgaatagctgggactacaggccacactccttgaggagtgtaacctctgcagcaatctcacacttttccatggcatttggtcataactgtggtcactcacaggaacacagaaatagtgtaggaagacaaccaaacattcatgatggaaataaaaaaaaccagaatgctggtgtccttcttctagtaactggagacgtgcccaatgaaactggcttgttgagcttcaaacaataatctcccttaaacagcagttggagaattaagttctaatcatttaaaatcatgagcactgacttcttaaaacatactagtattctgaattaatgagaaaaggacacggcaaagaatatcaaatacattggaaattttgttaaatttgagttaaggagagaaggcagacacgttgctaagcccagttgggttctcatagggttactgaatcagagggctggaagaagccccattttcaagcccccagacatgactgtctggaaaccacttggatgaacaagagtttagcttcgttaacagttttttagggaggggcttcgtaattttcctctgcaactccagagttctatttataaatatgtatagtggttttaaatagccattattcccctacctgtgtgcaagctatgtgaagtttggggtggcttataaaaatacatataagacaaaatgataacataaataattaacagaataaaaatgaggaaacaagggccaaaaaggaattaagagatgaaagcagcccactgagtaagcttactatttatcctgctgaggtaggataccaattcaactctgagctttctactagccaaagcaaagacacaagtgcatctgatgacaaggtttgaggtattaataagctacatacaaaccagttattcagcagaaataaagctctccctgggttaagctttgagagtttttctcggggcttctcatgaagaaaactggattatgcagtaaacaatatcgttcccaacatctcataatacatctaagaccatcccgcaccgtgccaggcgtagctggtggcagagcaggacgctccctgcacacagtgctcacatgctgcagccacagaggatgagagacggcatgtccccagcctctcctccttactggctgccattggaaagatcagacctgtcagagaagtcaatgcaaaaacatgaaaaaaacgtgtaattaaaaaaggagaaaaccttgagagatgcagtgttatacatgcctctagtttcataactcccaaatttctagatttgatttgattttattgttttttaagagacagggtcttgctctgtcacccaggctggagtacagaggtatgattatagctcactgcagtctcaaactcctgggctcaagcgatcctcttgcctcagcctcccaagtagttgggactacaggcacgtgccaccacacccagctgttttttaattatttgtatagatggggtctcactatgttgcccaggctggcctctaactcctgtcctcaagcaatcctcccacctcagcctccccaagaactgggattgcaggcatgagctgctgcactgaaacccctaatttctagattttaaattcaaatttaccaacactaaatagggtcatgtttatgtctcccaagagcaccaaatgcactgtgggtaaacaactctttccaggcctcagttggttaatcttccaaccagtatttcactgttgactaatgatgagcatggctccagactctttccacgtgtttatgttataataaacatatggataaagcatttaacatggtgcctggcacatgaccacgccaggtgtcagctattgctgttagttcatttcatctgcacatctccatgacagaaatactcgaaagcaggagccttgttacagatgaagcacagagaggttggataacttgcccaagatcacacagccagtagtggaagaattgggatttgaacctagatagtcatggtctcgactccaagtacttcaccgccccactctatgcccttgcttggtaaatccgtgtgaggagtctttcatagacctaaagcaccattgaatggatcctcagaaaacttaatttcatcactattaagtattctaaaagaacatcttcagagtggccctgaagacagtcatggatgagggttacagacgtgagctgagcagggcagccacgaaggagcaaggcagggccccgtgggagacttggaaggtggcaatgtttatgtagagatataaataggttttgataagtttggtctaaaagaaatagtcatctcaatttgcagttaagcgttctatgcttctccccaaaacttcattgctgtgcccagcagggtgcatgttttacacagatgatgggcaaacattcttaagtgcaaaaggaaaccagacaaaaagtccccatgacgagacagccgagtgggagtgcatctgactctgactgcaggcccaaaaagatggaggtgaggaccaggacaggagctggaccactggggaagcagtcaatctaattttttaagattaaataaaataagtccaagatgaaagcctccttgagctgtcgtccatacataataccccttaaacaaaaaaaaagcggggttggtggtggggactaatattactgaaaaaacatactgagaaatgtaaaatttggtctttagtctttgaaaaacaaaataaacttggcatctgactttggttttctcacatcagagtctacttacagcgaggcaatttccgtcatggaaagaacccgcaatgaaatggcacagccgtggccattagcttgacaagcatggagcctcagcccttgtgagtgtgaatgggcctcatttatccaagaacggcactgaatacatcccagaggggcagccccaagctcgctggccacattaaatctgattcaccctcacttcagaacacttagcaggggcccactccttggagaaagtccaaggcaagtcagaatgtaattgcggaaatcaatatgtcttcttctttgagtcagtggaggcaaacccgctaatcctgtcgaaaatctacctattcttctagagccatcctccttcctaatcctctgaattcctcttgcacctggacacgactttccaaccccttgttctccatcacatgctggtgaaatgtccccgaactcttccaaagctttctccctcctgctaccagagtgctctcccccaaacagaaatgcaagctgcccatgtccaacctaacccccatcatggcccagagcccctccctagattctcctcagtgatctggctctggagcccctcaattcactcatttgtttagcaaatatctgtggagcatctttctaggccaagcactgccccaggtactggagttatatcagtgtctctattaacatggggctggcatttgagtagccaaagcccctctccccaactccatgtgctctgtgctcaaagaccacattccacatcaccccctagtctcttcccttcaggccttcacttttgctactccctctgccttcaaggcctatgaccacctgatacctgccctattcacctgttcaccacctggtacctgctctattcacctgtccatgctcacctctaggttctctacaagcctttcctgggccgccagagaggaatgtctcccttccaattgcaccattctctgtattttctcagtaagtgtctgcaggatgagtgagtacatttatgaatgaatcttccatttaaatattgagttccttatctcatacctgcagtgcaagagaaagcccctcgtgttgcagtcagaaaaccattgctgaccttggttgaccttagatgggtcacctaacctttcgaggctcaactccttcattcataaaaatgaatggatgctttcttgaggttgctgtgaggacatccctgagatgatgcctgtgaagaaagtctgcaaactgtgaagcactatacagattaacacagcaacatactgcatgtgcatggctgtgcatgcgtgtatgtgggtgtaaatgtgaggctttttgttcttggcaactgttcataactgtacctcggtgaactcttaggtaggtcaggaagctaaggtttactattgtgcagtgttcagcatgcaactgctttttggaatgtcactgtctttctgaatgttccttttggtttattaggttagttcacattaagaagaacttggtgaggaagccacatggaagaaatggaaaggctttctttggcagctctaccctaagagggcaaaggggtcagttctgcgagagaacccccacaaggaggctggcccgggacaagcattccaggcctgtctcaagtctgaatacaaataaatcccttctcaggtggttttcttcataaggatcctaaaagcatatacttagtcctaatcgactgagcaagctcctaatcaagtttcatagtgtgaatcggaggtcagtcaccacaaaaggtatttttaggaccccagacaaggaggggattgtctggagcgctgcagggtaatttgtgggtctgttttatttctgaatcagaggcagtggaaaagctgtttcagaccccatggctggagcagcgggtggagctcagcagtgattcatgtagaactccgggctcaaactgaaaccgtagatgtttgtcttcacagctgtgtgttatttttacccttactaaatattctctcttacacctggaatttcagcctcttcccaacagtcctgttccctcccccttccctgaagcagttgaagacaaaattaattaaaaagtcaccaccagctcaccaacagttagttctttgtccccttaaaggggctcgatgtttccctgagaaagtttcattatttaagtttatatttctctttacagccaaaaacgaatgccagcaagaccgtgttgcttttagatcttgaaaactggagggaaatgcaccattttgggattcatcatttgaaaacaaaatgttctgtagcataagatctctacaagcagttacatgacaaagatcagatgtgacatcttttctatcttgtgcacgtcttttaatttgtctgaaagactcctttttcagagaagaaaggattgagcccaatagccagtatggtgcttcatgtttttataacaggccaggtgaatcctggtaaccaaaacaattttactttctttttttcttttttttttttttttgagacggagttttgctcttgttgcctaggctggagtgcaatggcgcgatctcagctcactgcaacctccgcccccactgggttcaagcgattctcccgcctcagcctccgggattataggcacctggctaattttttttttaatatatatttttagtagagatggggtttcaccatgttggccaggctggtctcgaactcctgacccacctattatttttaaaatgtgattgttttggaaacacctggtgaggttaatgtaaaggtgagtgcaggtgaactgacctgatgtgataaagtaagatagtaataaatgtttctaaaatgtgtaacatatacaaaaaatcaaaatgcagttggcacttggatttggtgcatcttgtcactgcttgtctgacacgtggagagaaccttgctatccctctcaatgcaggaaagacgttcagcttcttctaagaagccctgagggagtgaagaagagtccaggcctgtggtcaaatggccaactttcactttcactaactttcacttgagcaagtgacgaaaacttttggaaactcagtggtcatccgtaaatgtgaataatcataataatgtcatctcatagatgtttgagaaaactggacaatatgttgtataccaaaatctattaataaatcatgtgggttttagaaatatgggttaatattatccctttcagggtctttttctcctgcccaggtagagttgatggtaccctcatatctgttattgctgggccctgaacatcgctctgtactgaatgtgtcttatgatctcacagaatctttttcacctttggtagaccatgagctcctcttagttccttttttttttctttctctcttttttttttttgagacagagtcttgctctgtcactggagtgcagtgccgtgatctcagctcattgcaacctctgcctcccaggttcaagtgattctcctgtctcagcctcctgagtagctgggactacaggcacctgccaccatgcccagctaacttctgtattttttgtagagatgggggtttcaccatgttggccaggctggtcttgaactcctgacctcaagtgatctgcccacctcagcctcccaaagtgctgggattacaagtgtgagccacctgcacccggccagcttcacttaattcttaatccatctccatcgaagctaacacagtccatgatgcagattaaacactaaatacacgttggtttcctgcagcatttgtcaacttcgacactagtgccactcggagccaggtcactctttggacaggtgggggtgggggctgcaggggcgctgccctgtgtactgcaggatgtccccggcctctacccaccagacaccagtaacacctcccagctgtgaccagcagaaacacgagcattggcaaatgcctctgggggccacatcacgatggttgagaaccactgggctaatgaattaagatccactgagctcaggcaaggaggcaagagcctcttgttttacctggtgtttattagagagaagttcctgtccccagtgtctggggtgatgcttaaaaggggcccttaaaggggcctctatgctcatgaggattcctagttatggtttgtccgtaccttgtttggggtacattccccaagccttggcccatcctcgcttcctcttttcctcatgccatatgtccaacccatcagcaaagcacgttaattccaccttccaactatacccaggatgcgactgcctctcccaccctcccttgctaccactctcacccactctcacgcagatgtctcccatcctacacccacattttctcaggaagacttcaacacaggagccagagaggccctgcaaaatctaagtaacactatatccctcctttgcctcaagtcccctaatgatttctgaactcaccagaaagtgaaagtcaaagtccggcaatggccccacgggctctccaaactcatcatctattactcttcttcttggacactaaacagcagccacgatggcctgcttgttgtcctcgaacacctcaagctgacctcagggcctttgcatttagcattccctcctcttggaatattttctgctgtttaatcacgggcattctccctcaactgcctttgcagctttactcaaacatcacttttttgtgatcttctccagccaccttctttagagctgccatccgcttcacgtctttatttttctccttagcatttaccatgatctaacctgctgtgttttcataagtggtctgatgtcatgaccatcttcactgctagaaagtgaacttagtgaggcaaaacttttttgtatattttatcactctatcccaagagactaggaaagtaggtgctcaataaatattcattgaatgaatgaatgactccacgcataaacagtatgtctaaggccctgatggacccagcagatactccctactttttctcatctccatcacatgacaaatggcatgttttttaaataacatctataaaacatcctgctatctgacccgaggctggagttattcatggcatgcaatgaatctatcccagagagaggcaaggcccagatagcattgtctctcgctgcacaggcccagctgggcaaagcgccaatgtggcgggagggaaggaggtatttctcaactcaggcaaggacttctggggaacaaccccacctccgcgtagatcctcccagatcattcgctgggtgggtcacctttacccagctgctgggctttctcatttttcatctccttggatcgtgcaacagagcagtggttctcagactaccaggcatcggaatcccgcagagggctccttcaaacacagcgtgctgggctgccacccaggtctcttccgattctagggcagggcctaagaagccgcatctcaaacaagctcccaggtggaggtgatgctgctggtcccggagcccacgctgagaatcaccacaccgggggaaccctcactcaacagaatcaaacatggcaatggctccaggtggcctgcagactgggctgaggggggactcacagcatggcacataaattgactgagttccacctgcagtgagcctccaggtgggcttcacgaaatcgccatcgcctgtggaaaggggaaggtgccacttagtgtaagctgcctgtgatctggctggcctgagctggggatgctcagatggaggaaaagcagcctgctctgcacagacctgccagcctgctcacgagaagacagtttgcttgtggaccatgagtgagcaggtgttacctcttggcttatcctgctagtctatcatgacttgagctttggggacctcacagcaaattcagggcattggtagggagctcacgagaggctgagcaggcgctgaaactcccagccaggcccttggtgtggatggcacaggaaaacagctggttttagtttggccacacactgacagttctccattgtgtgaacacttggggctttctggtgcgtgaggctagagtgaagaaagggagagggtggctgtggaccaccgaagctgaaaaatgatgtcctgtgtctacacaacgtgcaattagattactgtctgcaagaatgctgctgtttgatctggcagtggccaagccaaacccacaaggacatcccagttggctcgcaaagcagtggttcctttctctcctgtttttcttttattatgctttacagaaactctattataatggcaacagatctcgtttcaccacttgtatttcatttcaggagcttgtaagcacgttaggactgaggttttgtagaattccactattcggttgggaactaagtccttcctttctctcaaagcacatggcctttttctccgtgggtactggatggatagggatggacagagggcactattcccaagctgggtattctaggcagaaggaggtgggccatgttctggaaagacctaagctgcagagagtgcacttctcccgtggaggtgtctgcaagatagtcaggggccacaaaggtaacagcccacaagttctagccaaagagtaatatttgacttacgtaacttccccttggacttgacttcaagtggcatgtgcactacaggaaagcccattatgcataagctaagaggagggacaattagaagaagctattgggccaggggccaggagatgggctaactccctggcacagctggcctggggcttccgagtctggaaggatgcaggtgcaggtagtggagcgttgaggagctgcactcctggcggggctcctccagaggcaggcagccacacactgctctgcagcatctcatctgtgagcccctccgtggcagaatctgcgtctccgtgaaccctgcctctgccctggcccctcgagctgggctgacacagcccggtgctggttcacggtgtccaaaataaagcagagtgaatcacgcccatgttcccttttatggagctgcacctgacattcgtaaagagcccatagtgaggccgggcatggtggctcacgcttgtaatcccagcactttgggaggctgaggcgggtggatcacctgaggtaaggagttcgagaccagcctggacaacatggtgaagccccatctccgctaaaaatatgaaaactagccactcgggaggctgaggcaggagaatcgcttgaactcgggaggcagaggttgcagtgagccgagattgtgccattgcattccagcctgggtgacaagagcaaaactgtctcaaaaaaaaaaaaaaaaaaaaaaaaaagcccacagtgagtcagcaaagcctgcggatgggatcccaggcagtcctttgtctgccccaaggctgcctccaacctctggctgagatgagtcttagctccactgataactgttcagctttcttttcccccattccccttcaggaagcccgttggattgttaatagcagaacactgactcaccacttatgtttcaattctttcagatcactgagcttgagcagccccctagtgaacctctgacctgacacgccaccccctttaccacccgctgtccagtcaggctgagctccagcagcagcggtgaactggccccccagagcacactggtttggagatctaaaaagtacaatgggtcaccagtcactgatgagtgcagcatccctggaagtcaggtgtgggggtcagtttcctgtgtcaacttggccaggccgtagcacccagtgacttaatcaaatgctaactgaggttgtactgggaaggcatttgcacaggtagctagtcagttgaacttgactaaaggagatgatgtcagataatgtgagtgggccttgtctaatcagttgaaggccttaagaacaaagcctgcggtttccagagcagaagaaattctgcctactttccagcctgccagcctcccctgcagatctcagacctgcccactcccacaactgcattagccaattccttcaaataaatatcttaaaatgtaaaaatatcctataagttctatttctctagagaatcccaactgatacaccaggccagcacccagacacaatgccaggagacacactgagctctgggggagacgggcatgagctctgtatctttctcttctacaaaggggattagtgtcagccactcctctccctccccctggaacatccttgtgggtaggggacgatgacacttggtgactggttgacatctgtacattgctagatgcctcaaagcggaggcagcctctgcagccagtgttcctcccctgcctattacaacccagctgcccttttcctcaaaggaggcacgtaggcctggattgaaggcagatgaggtccaccttgttcccttcatgaacagcacctgccaaaccgacatcaccgaacccaccggaggacccggaggatgaagaggatgacatgatggtcttcactcggtatccacccaccaaaacacatcaccgatgctttaggagctggaacagcattgaaagtttatgacggcagcaatctgggcaatgttagaattctatgagccctgagagaggaactcttaaagttcccattgtttccttgaaagaaaatgtcaaggccgggcgcggtggctaacacctgtaatcccagcaatctgagaggccaagatgggtggattgagttcgagaccagcctggccaacatggtgaaaccccatctctactaaaaatacaaaatttagccaggcatggtggcggatgcctgtaatcccagctactcaggaggctgaggcaggggagtcgcttgaaccccggggggtggaggttgcagtaagctgagatcgtgccacttccctgcagcctgggtaaaaaagagcaaaactccatctaaaagaaaaataaaaaagaaagaaaatgtccagttcccctgaaaaagatgtttcccggaaagagaccctcagcgcagcaccagcctttcacttgcctgacagaaaaaccacccaagagctttccccagtctgctgcgctgagggccctggggcggaactgccctggtgtctttcttatggactgaagctcctggtgtctttctttcttatagactgtagccccttgcctggggctcagggttaccccaaactcccaacctgtacccctggggtcacaacacaggctggaaaagcttccccatgcctggccaggagggagaggagacatcagctaccaaggggcatcacaggctcacactaaggaaaacagtgtttgcacttctcccacaaacagaatgcttatttttttattttttatttttatttttttgagatggagtttctctctgtcgcccaggctggagtgcagtggcgcgatctcggctcactgcaagctccgcctcccgggttcatgccattctcctgcctcagcctcccgagtagctgggactacaggtgcccaccaccacgcccggctaattttttgtatttttagtagagacagggtttcaccatgttagccaggatggtctcgatctcttgacctcgtgatccacccgccttggcctcccagagtgctgggattacaggcgtgagccactgcgcccggccagaatgcttattttattttaaattcgggagtaacacagtgagaacaatagaaactttcatttctggagcactgttctcgcctcctcactcagtctcccttcggaggcttgctgaatccagactggccccaggccagactctcaaacaagggccaggacatggctcactctgcctgttgtccatcggaaatcatctcagtgcccttttgtctgagatgtttccttcctctctccccaccttccaacatccccctcctccctgcaggtgaattgctcataggtagaaattagcctctgcagaagaaaagctttagaaatgtgtcccggtcttagtgtctccgccgtgatcacgctggcatatatgggatcatatgaccccacccaaaacagaattcattcagtgtttccaggctgtgttccaccaactgatctactgcataaacactgctgcattctttagaacatgattaccctgcattcttctgtgtttcagaaatatatatagttaatgatcaacagaaacattgtatcaaatgcataggatttatgggtaaaaaatatttacatgtaatcattaatttcccacaactttggtgtcctggacccatcattgcattttctatccaggtccttctgtaactccaggaatgaatctcttgatgagattcaaaaatatttacatgtaatcattaatttcccacaactttggtgtcctggacccatcattgcattttctacccaggtccttctgtaactccaggaatgaatctcctgatgagattcaagatgggcctgcctcgagttccacttaaaggaccagtgcggtggcaatatgtagcatcagagccagtgcactttcaagaagcagatgcacagacgcaaactgacttctcagagtggaggagtgttctggcatctcccatctccccatctggcacgtccagccttgccgttgacattccctctaggacactgtgacttggcaccttcattaacaccacactaggaattgacgcaaccgtttccagacttataaactatgacacttataataaacctttttagcgttaaaacatatatgtaacaaaaaggccccattacagcttcaacagagtggaaaatgctcagggtgtggagtcaaacactcctggtttaaatccaaactctgattccatttaagtggtgatttggggtcagactggaaatgcctgatcacaggtttcttcatccatcaaatggggtcaagtatacttcatgaggggctgctcggaggactgaggggctactggatataaaagggctttgtacacagtaaagtttccgaaaatgtgagctgttcttatgacctgatggtagattatgcaacatttcgaagaaataatctgttctttatcctaagatttgatattctttttcctgaatatatatggggtattagatcataattgaaattaattttacttttcaaaactacacagaattcaacactttttgagggccagggacagttctgcatttggtaatacattttacgtgacagttgtatgttcatgacaaactcagggaagctaataattatgggagacactggagagggctttatgtgtaagctaagaggaggaaaaaaaaaaaaaacaaacagcaggcattaagagaagaggaccgcagagatcagagggtggggtgagggtggagggcagacaatggagatccactagcaaattcaagtggcttggacatacgccgcactgcctggccactagctgacactctccctttgtgaaaacataagacggcattattttccaggcaatcaaacctcagatgaattctgccatatgtgggcaaggctcccctcccacagagccctcgtgcctgggaaatagaattgaacacatcttcaaagagagttcttggtaaatatactactaattttacaaactccatcctctacacaaaccactggagaacacattttcccagcgctgtccaacgtcaccgttcaatggcctttctttctttctttcttcttctttttttttttttttttttgttagccagagtcttgctctgtcgcccaggctggagtgcagtggcatgatcccggctcactgcaacctctgcctcctggattcaagtgattctcctgcctcaggctcccgagtagctgggattacaggcacagtggccttgctttctaagtcaatctttagagaagcatgactgacttccactttgcctttgcaaaggataggaaaatgggaggtcagggagagaaaggggcggaagtctccttaccttgagccattcacctggctagggttacattccattttgatggtgaccctggctgggggttgagacagccaatcctgctgagggacgcgtgggctcatcttggaagtctgtccatagtcgctggaggaggacgcggtcatctctgtcttagccaggtgtggcgttccgtaggcacactcaaacaacgactggtcctcactcacaactgataaggcttcctgaatgcccaaagaaacacataattcaagacactccaacagacagtcatgtttcaaaaagttgttgatttcagagtcctttctaactgggaccacattttagatcgtttttatggtctccatttctacctttcagaagaaaaaagtagcttgtttttctttcctcgggacagtaagagttagaaatgccagcctagaaaaacttttatgcaggtctcgaagcatcccaggcttgactgtggcagggcagcagaatatccactttaatctcaacttaaggaagttgaatttcaaaggtcttagaagacatccaattgcatgtgtcactatttgacaaatgcaatctataattcaagcagacagggtacagagcggtcatgaggattaaaaaaaagaaatctgaaggccaacacctaagcatctggcaaaattgccacattcctggggattttgcggaagagggacttagaggaagacagagggatcaatggagcaccaaagggcaaccaaccaaagatacaaacgtttccactctaagttattagccgaagtacagtttcaagtggtgcttccatgatggtgagcatctggatgataaatgaaccaaaaaaaaaaaaaaaaaaaaaaaaaaagctgtgaagtatccagatgcttccaaacagcaggatgtttaaaatatctggatcactgacaagctcttttttccccttactttcaattaatatcttcgctcttttgcatgatttggtgagaagaaatagcaatttgtcattgttggatcaatcatttttcgtggttttaagtcaaacaagtggttagccaatggctatgtttatattctacagccaatgagcaacggcaagtttgggaaatttcaacgacttaaatgatggcttgtgctgcaatgacacagagctgttgtgatacaatccaattttggttcttataacagacaaaaagaattccacatgaatgctcatttttatattagtcctttggcatcctcagtattgacatcaactagtgagaagcaaaggctagttgggccacacatttttatttaaaaaaaaagaaaaagaaaagaactttggaggcagagcaggggaggcaggggagtgtgggctgcgcagacccttccagtccaaacttgtcatctccaaatgagaaatctgagacccagaaaggtctagagctaatcttgaatgagctggccatgatcaaccaggggattagtgatgggaatgacttgtgtattaccatctgccttctccttgcccccacagccctatgatgccctttgtgacatttttttcctttgggacatgtgtttaaattagcaccctcttccccttctctgagatgacctttacataaataagggtgcttcccatcagtaatcacaccctagaagcagcccttctgagatggagagcttcctctccacccagaaggatcagaatttttaggaaacaatcacccccaactccacatctactctgtcgctcgatcctccacctgtcccaggaccaagttttttccttagcttcccaagtgcacaaacttctttgccagacacacggcactgagaatcagcaaggaggaagaatcaaaacaaactcaaacctctgtctctcaaagtggtggtcaggtgtctgtgctaaagcaaaagcccccatcctggactccataagtatctgtagaattacagccctgtgacaccctgggaaagactaagcctgctgtccaaacagtaatgcaaaatgtaccaaagagtcaggtaggccagacagagaaccagaatcaggcacaagggaaaaaagtcatcttgaatagacagcaaaatcaaactcatcaacaaccaaaaatgatacgaggcagtgacacagaagttgacagtacagaaacggcatcctagatgttagggaacctgaaattcatggctttctcttccagtcacaattgagtggccaaaacaaggaatctaaacacatagatgtgggtttcaaagtaaaatcagcaccatagacttagtcatgctaattaagacaaaaattagaccttattaaaaaatttttgcaaaacagatactcccttcccatggtggcactggctagtgtgttttacaggctcagaacaggaaacagagctgatggctgctgcctctctccttcctgggcctgagactcgaccaaggctcgcaggggaataacacactatgtaatgttagctttggctcacccatgatgagaaacatgaacaaatgtgtgatttatatcagaaattggcgaaaacaggttatatatataagaaacaggctaaatttaaaattacaaactaaaaaggaaatggctgcaacaataacaaacaagcaataactttaaagtattagtatttctccaagataaagtaagcttacttctgcaaacaaagccaatagccacaaaaatgtagtgtaagtttgaataataaaaaaaagaccaaaatattagaactaaaatgaagcttaagtgtgtgtttgtaggggaaggaatccattctcacatctggcaaagcattatttcagcacatggttttctaaagaaagaaatcaaagttaattgagatcgatttaggaaggaaaaaaccctcagaaatgctagagatgggggaggcatgcctcctttttttgcatcttaaaattcttctcacagctaatattgcacaaaaatgaggaagggaatataattcagaatattgaaagcaacccctcagttgcttttgttcattagaagggaaaaattctgaaaataaggaagcttcaggataaacacttcaaaagaggtgaaatacagtccacattttgaaaagacagagcaacccaaactatgccccaaagactttgttgattgtcactcaacaaaggctgctgaacacctaggatgaagtacagctcaggaaaaggaaacaaatgaataaagaaaatctctctcacatacacattttgggagtaagaagaagctgaggggttttcacagacccattcccacaacagcggtcactaaagttaagtgctgctcttcagaagcaaaccaaggcacagccctgccacatctttgtcctcccacttgacttggctgttggcaggtttcatcatcccttcggttaaagcttgaatggacacacgctgctgcatagggccctccctgcctggcagccctgtgacttcaaaggggagagaggatctagcccagtaggattaaaaccagaaaaagagtgctgaacacaggctgctaatcaggaccacatgagttctttaactccagctctgggagagacttcctggccttgactgacatgtctctccttccctgcagcctggctcctcctctttataactagcagatctcacctacctacttacctgcctgcctacctgccggccaaggtaggcagctgccttagttagcatgtatagattgttattgcagaaactctggccagccacaaggcttgggatctgcttcagtggctttataacagagaatattttaaacgtcaaaatctggcagatatgtggcataatcatttcatatgcctgcttctatgttactataaaaagacctgaactttagattggtgtttgccaatgtgtggggtgtttttttctgtagctccaggaaagttgggatattcccatcaggcaaatggcaggctaccaagctcatttttaaataacttacgagaaacacataattctaagcaaattacccccaaacaaaaggtactactgtgttagtactgtagtattgattatttcatttcaatacggaatataccaataacacatgaggaccattcctttggattttggtcatgggataacagttccagaaatgaagggaggtcccaccaggttatatttcatattataactctaaaatatgcatctattttcaagtaactagagtacaaaaaaggatccaaaatacattagaacactgaaaaagaaaactaacaaagttgaatgcatactgacattttcagcaaagtatttcaggaatcctgatgcctttctataacagatgaatactttgcaagatgcctatttctcaaccaaagtattagaaaataaaggcccaaaattgattctaatttgtgatccttatagctcataaaaatattacattgttaatacagagaatccatcatacttaacctcttttgaaaatttgggagtggtaaagtgttgaaactgagaaaatctttaagaatggtcaggtgaatttcacatctggagtaagcaaaggcatccatggtcctttcgtggttttcaaaaattaggaagatggccagaactaggcctctcgagaattggattatcaaacccaccttcaatgttttcaagtcttatatgctataattatttgataattatgaaaaacaaatggaacaactaagtggaacaagaattgtatgatcatgatcatgcttaaaaaaaaaaaaatcttggttcgggcatggtggctcacccctgtaatccaagcactttgagaggccaaggtgggtgggtcatgagttcaggagatcgagaccatacaaaaatccaaaaaaaaaacaaagaaaaaaaaatagccaggcgtgatggtgggcgcctgtagtcccagctactcaagagggtgaggcaggagaattgcttgaacccgggaagcggaggttgcagtgagccgggatcacgcgactgcactccagccgaggtgacagagtgagactccatctcaaaaaaataaaataaaataagaaataaaaaataaaaaaatcttaaagaagtccttgctgctatcacaacacagtgtggagatcattcacttaggaagccagcatcatcttcaatcaatagcctactttttctgtcagttttaatcccattacaatccaatacaaaacccttccttaaatttccctcacatataaccacgcagaatttggtacatcacttaactccctatattgccatcttttaaccactttcataaatagcttatccaccaaataaaccaggttaccttaagcactttcatgcaatatcctcttaaattctattttgttgattacaagatacaccacttgtcacattttatcagctctgaaatatgaaaatgaaaggcttatcctaggtatcaggcagcatttcttcttctctgatggcagataaaataatgggacattttatatccaatgacatcttacattttatgaaaaatgatcatttaatccttacaattgtcctataaggtcagctgtgattcttgcccacccatcagaaagtgcgattagagaagtaacatcaacagtgaggatgaggcagaaacagggtttgtgtctgtgaatggaatcattccccaaggctgtagactggccactacctggctgttactggaaggaagaagttggattaagaaaagtcacacggtggagtgttttggtgcctgctcttgccatgagagatggaatcacctagagagagacagagagagagaggctggtagagggaagagacagaagaaagatgaagggataagtgtccagaatccctggatctgggatggaataaaggatctggatggtaaacggagagtgctgggaaccagtaaggacttctctaggtataccatgctcttctatgagcctaggggatgtgtagcaatgggccctgcatacagttaatcatttcttttgcaatggcttaaatcaacaaccttgttcttttctttgattaatcagattattcagacacaaagacatggccaggtgttgggatgtgttcattgcaggtggatgcctgccttctcttaatgagtactatgcaggaaaactaggacaggtaggagtaccatttataaatatgctggagcctatgccactttgggcggcctttagtggatgtctgcagacctaaggatattggaaatctatctattaggctgtcgcaggctctattgtttatagtttctcttcaaggcagcacatatgcagtagatgcttctaaaaggtctagtatctaattgtatttggaggaggaaaaaacaacacaaacaaaatagacaatgcacttagagaaagctctgctctcccaccataagcctgacaaagatactccagtccttcaggagtttttattctaaatgtgtgcacttttgcaattctgatgccaccagtatctcattaaacaagaatcttcatctgaccagtgtgtcttttatttacaacacacaaaaaagcgaaacgtggtaagtgaaagaagcttcacaaagctgggtatgatcatttttgccccttcttgatatgattttcttttcttcttaattcttcagagaaggaagtattaacatcgtatattaaatgcagcatctagctttgtgttcacgtttttctaatttaacacattgcaattttagtccttcaaaactataaaaaaaatcttggattaacctcaaaggaaaaatgtatgtaggcaaatgaagtccatctaaagagagtatttctccaatatggtatcacttcagtgtcaaataatttcaccactcacaacactagtccagtgctaagaaatgagacccagaactagtgtccagatacatttgcacatacagatatacaaacacatacacatgcttacatatgtacacatatacatgtgtgcatgcatgcaaatacatacatgcgcaaatacatatatacatacacacacatatatacagatacgcacatgcatatacacaaatacatatataagtgtatgcatatatgcaaatagatacctacagaaatacatgcagatatacaatacataatgtatatacaaaaatatcatacatatgtatacatattactaaatacatactaagataataaggagagatgaaaatctttatccttattatctttattaatagaacgctttagaggactttcagatattctttatctttaatcatatccactagggcaaatgttgcctaaaagatacagagaacctggcttcttcccatttcacctctgctccttcctctctcatcctagaaggtgcttttccctatgctcagcacatcccttcagaacagacttagctggggatccatcccctccatgtccttcagccaattttcccggctctggactcacagactttctcagggctctgagaaggcctggctggtgccagcaattctctttgcccacatacttctcccctggccttgcctttattcaaatataagcattttcagggctggctcctctgtatgtctgcctctagaaataagataatttcttaacctcaaatgcttgttggtgttcatattagccctaggactaagacatcaggtgatattacagccccatcataatgctataaatgggatccacaaacttctattacatccaaatgaagagacgtgtttttgtgagatgaatggattgtgtagccaacgcccaggagttccagggagtttggaaaataattgccattggcaatatgtctgcagtcatactaccaaagagcgtattattgcagagtttcaccttcaatccacataggcttaaatagggacttcctatagctaagcaacctatgaacaaaataagacttactggaaaatgaacgtttgcaaaagaaggagggagcattcaatctggaaagcagaaactctagaaatattgtgaaagattggagcatggtagaaaaatgttaaagaaagaatagttatgtccacataatgaaaattagatttaaatgagccttgggagatcaagaatgtcaaccaacatcattttaaaacaactctgttttctcagtgccatgcagaataaacctcgaatgcatttgaaaggacaatgaactgggactctttgccctggcaaatgccatttaactgtttaagaaacaacatgcctgtgatgtgaatagcttcttattttcttctttaaagaatcgcttttttggctgggtgcagtggctcactccagtaatcccagcattttggcaggccgaggcaggtggatcacctgaggtcaggagttggagagcaggctggccaacatgatgaaaccctgtctctactaaaaatacaaaaagttagctgggtgtggtggtgtgcacctgcaatctcagctactcaggaggctgagacaagagaatcgcttgaacccgggagggggaggctgcagtgagctgagatcgcgccacggcactctagcctgggcaacaagagaaaaactccatcaaaaaaaaaaaaaaaagaagaagaagaatcactttttcttcccagtaggcttctttccttctttggagatgagcaaaaagtataaaaacatctgtggaaacctcctgtttgtatgttttacattggaatgggtgcaaaaaatacactcactattcctttacatccttctaagagggctgtttctactcttgacactcaatacttgtttttgtttctctaatcactgttatacgttactcacgaatattcatcaaaacccttttccttattttttatctagttttaaataattcatttgagataaaaagaagtttttctttgctttttttaatcactcagtggaggatgaacatgaagctgtaccaatggataggagaccgtctggtagagcacgggagccagggatagggatctgaagatggaagatgtgagtttcaagctgggctctgcccttgctctgggaatcacctgggtaaatcctttaaccctttcctgccccaagtgtgagctgagagcttgccagaaatgcagattccgagtctccagccctgctgagtcagaatctgctttgtaacaacttccccaggtgagctgggtgcctgctcacttcaacaagtgctgcattatccttttttgactctcaatttcttcaactataaaggtggtactgatggcaaccagctgccgagcagctctctcccaggacagttaaatgggccaaataatctagtgtgtgtaacaggtttcataaatcttaatattgtatttaaattatcatatgatagaagggtgatgtgactgactccaaacctctgcatgtgaaccatcagaattatccattctagtcatattattctaacaagccagatgcaaggaaaatcacagtctcttgtgtgcaaattatcacttattttttgtaagtactggattttcaaaccaagtatctacctaacagaggggaagggagatctagcatcttttacttcaagagcacgtctgtcactttgatttatagcctttttggtccctggtccagttcttttgtgggttttccattcaaattctacattagtttgtttaatgtcaattaaatcaaagctttgtgcaggaaggaatgaatcctggtacactccccagcgtgctgttggtattctctacataacaagataataaattaatagatataccatggtcttataacataatgttctttttctttctttctttctttctttctttttttttttttttacctagaatagcacaaggcacaaagttgatagccctcaaacttctgaagaaaagtcttttcttccaggatgtggaatccataatgctttctatgttaactttccctaaaaattgttgaatttttcataaacttctatgaggaagtgtttccatggcagtctggctaagaggttcacaccatcattctgtcctggtgatttttgaaacttacaagcccaggttgaaactcaggtgattcaaggcttgagaaacacaaaggccaagctcaaggagtagcaaagttgcttgcactttttttctattggcatggtccttctctgaacaccagggaaggggtggtgcaccacctctctcctcttcagaaggagctccgtgaaaaatcggcagttttatgcttggccctttcaaaacacacaaaggctaaaaatacagtgtgctacgcatctggaatgtgtctcatctgtgaatctctgacacatggattcattgttttcgataaaattccaggaattttattcatgagaaaattctggcacaatggaaaaccctggcaagcaaaagataggggcagcagatgtcctggcctccacccacaactctgtctctgcttttagctaattttcatcaggtgtcactctcatgccttcaaacactcaattcaaaatttcccataagacgggggtgagggggtgggggtgtcaaaacagccttaattttttaaataattggtacggtcccccccctccccacagacaggtgtgtcacaccaggttcaacatgcacgtgccaggatgcaggatgggcactttaagaagaagccgcaagaccacagggccactggccatggggctccaccactccgtgcccctcatgtaccaagtcttcaagctcctcgtctaaaatgagggtctggtctactgatgttttctaagactccattttgcaccaaaatgagatcgatttgtttaactagtaacatcctctttcagccatagccaggctgcagtctctacctcctccatctctgagcagacatgcagataaggtagaaatctaccatgtatggagttgctaaaaagttcctatgcatccaggttagatgctaactgcagggtctttccctgctgcccccagactttaattttcctcaatcttgtaggtatctccttctgtgctaatggtaagaagctagtcagcaccctgagagctagtgttatgtttttaagtgtggaaaggatctactctcttgcatgggaatatggcatctgttctacacataaagcacttcaataataataataaataaaaaaatttaaaaaataaaaaacacatggcaacatggtaataccaacagaaagtcttgtagaaactggggttctggcagacagaggagcacatgaataagtctccactattcacatgatggtccaggggtctccttcttttgctttctatccccatccccatcattgttggcatgggccacacactgtataacgcagacatgaacacagacgttttctttttcttagacgctgacttacgtagaaagagttagtcttcacccactgtgagggtccaatccctgccaaggtctttcttcagcttggtaagtgatgatgtctgactccctggggctgggatgctaagcctgtgcttttcagaagatttttccagcacataaatatatcctggttgctgcatggaaaggggactaagtagccaggtcatcagagccctttgctaatgttatacgctgagctcatgcttttcctatgacatagatgagcactgggtagaccccgtcctggtaacacttttcatgcactaacaagttggttgccagtgagacttgatttttatgactctgggagtgctgacctcaaaacctaatacatttgaactaggagagcaatccctccaacaatttcaaactacacatacttacatcacatccaatagggctcttttgccatctggcttgagcccctctataaatatgtctactttgaaagtcacaagcctgggcggggtggctcacacctgtaatcccagcactttgggaggtggaggcaggcagaccacgaggtcaggagatggaaaacatcctggctaacatggtgaaaccccatctctactaaaaatacaaaaaattagctgggcgtggtggcacatgcctgtagtcccagctactcaggaggctgaggcaggagaatcgcttgaacctgggggacagaggttgcagtgagccgagatcatgccactgcactctggcctgggcgaaagagcaagactctgtctcaaaaaaaaaaaaaaaagtcacaaatactctttgaaagtgtgcagagtcattcatatccaaaccatcaaggcctgcccaacagcctggtgacttgaaatcttgacgtgtacacagagtctaaacctcggtctttagattgcctccttactggacctctttacttattaagattcatccttgtggaggaagtgaggtcatggatgttcacatctatctttcccaggaagaaaaggaagcttcaagagctgggaaatgctatgcaccactgtgcaggttctgagcagcacagagccacctgtggggtgggcgggtaggtgagtagtggacatctgaccaccaggcgctgtgcaggactacctccttgcagagcaggtggggccttccaagttgcctactcatccaacctgcacagtaagccttatgggagcgtcatggggctacgcctacttcaaagagcaacttagctaaagggaaagagaatttgcacttgctctcttccactctagcagacttgcacttgtcgctatttatttgtgaacacagactcattttagattgacttaaaaataaaaaaaagtgcaaagaacagggcagctggaagttgggaaaccacttctgccactgctgaatctgaagccttaagctcctgaactggaaaaccagccgactggagcactgagctccctgggccctgtaaaagagcacactggccaggcatggtggctcgtgcctgtaatcccagcacttttggaggccaagacgggcagatcacgaggtcaggagttcgagaccagcctggccaacatggtgaaactctgtctctactaaaaatacaaatattagccaggtgtggtggcgtgtgcctgtaatcccagctactcggtaggccgaggctggagaatagcttgaacctgggaggtggaggttgcagtgagctgaggttgcgccactgcactccagcctgggtgacagagtgagactctggctcaaaaaaaaaaaaaaaaaaaagaatgcaccaagtagtggccagtcaggctcccatgggccttgacacgtgagatgtcaggcagaatttttattaatgaatctgatgccaattcagtatttctgcaatcacaatgcactttcgcaatatttatccaagcaatatttatccaacaaaaatatccaatatttatttatccaggatctcgcaaacgttcagtctagtttcactcacgtcagtgtctctaaccttcatactttgctttcaagcaagagtcgtgtgttggtctgggtgtccgaaggtgggggtggtagctggtgatgcaaggaaccaaaaattggccatacttacttacttaaatatttcacagctctttaacagattctcatctcctgctctcttctcttctccaaccttgccgtctggttctgacactgtcctgccacgattaggagtgagctttttggggttccctcaaacattcactcccagctggtctctttgttacctactcaagagcagttcatactgttggccactctccccttttttaaccctcttttctttggcttccatattcctgctattcctcctatttggttgacaattccatcccccatctctttatgccctcctttttctctcctcattctctaaatgtcagctttcctctgtgcactctcctgggccacttctctactaggctatcatttcttccaagccatcactcaggagccactccaatggcctcagcgctgccaggaagcgcagcgcatttaatttgaagggtgaaactgccttggagggatggcaggtgcatgcttaataacttgtttcccaaggccacataagtgtcattactggatgataattatcagctcaagagggaaagttctaagacagagaatgcaagatttctaaacaggtctaagacagttttccaatgtaagatttattatgtaacagttttgaaagtagtgtctgattccctgtctatatcctccagaacaatctgagggcatggttgccattacaatttactttgggggacgattttatagcacgtcttcacagacaacacgacaaacatctttgcttctgctacactgacaacctgaagttaacatttctgtacctatgtagccattttaatcaccccctaaactggttattccacagcccaggggtgtgggactgagtcagatgggctagagatacctttattcagaggatttagaagtttgcctcagagaaaggccatttctagtctccactagaaatcacacatatcttccaggaataagaatattctcttagtcataagttcaacaaatatgtactgaacaccttttctacttagaaacttgtctagctgcttctagattacatccatgacccaaaaccacaaagacacctatctgcataaggcttgtattctagcactacaagccacagataatttttgaaaatcaattaatcaaccaataattgatagggtaaatttataaccttgtttttcaagcctgatctcagggttagaaggtggtaagtgataagtatgaagaaacagaaggcagaactagagactcaggaaaagagaggtaaactgctgcttttcatttagagtggccagggtggtcctgagaaaacgcgaaggaggggagggtgtgagcccccatgcattcatgaagaataggccttccagccttggcaacagctagaacaaggccagagtggactgcgggggctgcacgaggaacaatgggaccaagaacagccagggaggaggggttactggaaaggagcgaaagaaagaaccaggaggtgaaccaggaaaggctgggggtggtagagccttgcaggccatggcaggaacctgggtgttgactcagagagaagtggagtctctctagccgtcttggctaaaagcccgggaattgtcttcttctgtgttgcactaatattttccatctcataagggttctgcaaagaaaattctttctatctttaaagttttattattttcaaaactaaatgtgatgagaatgcatatattgcatatgccatgtgtacaccaaaagccacacctaataaaatgttacagccatcctttgtcccacatgcaacgggaacttccattcatcatcacatgcagaaactctgggaactgagaatctgtacttttcattcagagtctgcaaggggtcacggccattttgaaaggctttgactcacacaggaaatacctcactgaggctcccacccacccatccactaatagggcagcctttagggaaactgacttgtggcaactgaaaggaataacggcaccaaagtattcccctgccctgaaatctctgtttacctgtggaccggtgatgggtgtgaggctgtaggttttaacgagctctgaatggcaaatggcagacaatggtgtcacttcctttctgcttaggaaggagacgtttggaaaaactgttcactgctgtgcttgcctatggagaacctggattcccagagctctatctggtagaacgtgtctccatattaataagcagtgaatcctcttttgcggctgaattttcctcaaggaagcagcatgggccttattactgccttaaaacccaatttcaatattcgatacatagtctgtgtattcatttgctagggttgccaagacaatgtaccacggactgaggggcttaagcaacagacatttattctctcatggctctggaagctggaagtcagagagcaaagtagcagcggggttgattcctcctgaggactccctccttagcttgtggatggtcatcttctccctgtctcttcatatcatcctccctctatgcatgcctgtttctgagtccaaattacctctttttataaggacatcagtcccactgaattaaggaccaccctaagggcctcattttaattggattacctctgtaaaggccctacctccaaataaggtcccactctgaggtcctgggggttaggacttcaacataactcagggaacactattcaacccataccatcctccaggaaggcagagaatgtgtccctcttcttcactgctgtatctccctgcctagcacagtgccaggtaccacactatgctctgtaggtcagtgattctccggagctctgtaggtcagtcattctcaaagtgttgtccaggaaccccctggggtccccagacccctctaagggcaggcataagcagatctgagaatccagctgcctccaattagcccagacattaaagagattgcaaaaaatgcaaaacaatgccacttctcattaacattttcttggaaaatagagttacttttcataaaaatatctcatttgtgttaacatgcaatgagtttatttatttatttttattttttgagatgaagtttcactcttgtcacccaggctggaatgcaatggtgtgatctcggctcactgcaacctccgcctcctgggttcaagtgattctcctgcctcagcctcctgaatagctgggattacaggcgtgtcccaccatgcctggctaatttttttttctttttctttttcttttttgagacggagtctcgccctgttgcccaggctggaatgcagtggcgcgatcttggctcactgcaaactctgcctcctgggttcatgccttctcctgcctcagcctcctgagtagctgggactacaggtacccgccaccacgcctggctaatttttttgtatttttagtagaaacagggtttcatgatattggctaggctggtcttgaactcctgacctcaggtgatctgcctgctttggcctcccaaagtgctgggattacagtcatgagccactgcacctggccttgttattgttatttttaaatgaatttataagtaaatgtttcaaaatttctgtttttgtttctaccaatagatataatgcatatacacaatttttttttaagaatcctcaaccaatcttaagaacgtaaaggggtcctgagaccaaaagattaagaatcactgccgtcgaggttttaagcttggctaggacacagtctgtacttactgaagtaacccacagtatgacagtaataagacactttatgaagaacatattttcagtagctaagtgtcatagaaaaggaagcttgttagccatttcctcaagttgacaacagagagtccttaggaaaataattttttaaagccaatattgagccttccaagactgcacatggtgatatgttaaatttggaatttatgcaacttaaaaaactgagagtcgggggttggcatttttgtgcatcctaactgacgagtgctgccccagggctctctaacactgcacacagtctactaaagaagcaggctgcccatcatgacccccacccatcagctacacagcacacatctgcttctagatgaaccttcttgcaagtggcctgtcttatggcaaaatcaaggggcaggcctgtaaagcggaccaggaaatgagcagcaactgcataccaccaacctgttgccaagctaactgtgcttttctggatcagaggcagcttgagacactggtccctggggctgagggactgcagagcccgggcacagactccctgcctatctcccagtgtgtccatcttggtacacctggtgcatctctggattggcaagtggcactccccaattaatgttaagggccacttgttttaaatataaccagattattttaatttttaaatgtgtatcccatacttggacactgaaaggtcctccctgtttacctgcttgctggggtctgtgcttgggtgtctcattttattataaaacagagtctcaaaggcatttaatactaagatcaagtggctgggcatccatcatgtgcagagcaggagcctgatggtggtgaaggctcattctgcatgtggttgactctaggaactactttaacagaggggaagaaatacactgggagaaaggagcaggagattcgtcagggctgggggaatactggctccatgagggcagagacttttttctattttttctctttttcagagcctgtaagtgtccacatatcatgcacatgcagtgcgtatttgttgcatgagctcctggtatgcaggtgccaaatgtcatgctaagtgtgtcgactggatgacagaagaaggaaggagggattaaaggaactggtgtgcactggcctgagccttgaagaatggggtgtactgggtaaatcaaaatggtggggagcatttccagatggagaaactgcaaggaaaagcatagaagtggggccacccctcgtgagctggggagggcccagggtatgtgtgctggttggggggaagctgaaactgaggaaattcccattggatccatagcctggttctggtttccacaggcctgggatgccccgtccagagtttgactttcagtctgcacgtaatccaggctttgtattcccacttcccgtatcccctcactcctttttcacacaccctttttatctatgatgctactggggtcatgggttaagaagtcctgtcgtctaagcagcaagggtgcatcaaagcaggattttctccattgattccaaggtgtgattcagaaatggtaaaaactccgaacactaggatgagcactggggatgggttcatgttttttttttatgaaataattcagaacttattaagaattcccttggcaaaccaaattaaatattaaacaactatttgttaatatgttactattggattctatcttagaaaagtgtaattatgtgtaactgaactttttgttttcttgtggttgaaccctgaattaccatgccttctggtttccgtgtttttcctggggaataggtcatatttcttacttccaaagcccagaaataaaagcctcacacatccatccgtagtcccaaaggcttttctgcctagtacccagagagtaacagcagtgcttcaaactatttgtggacaagaagtcctaaaacatcagacacactgtggaaagcaatttcatttcattaatacaattcataattaactgcatttattttattgtctaaattccaactgctaacctatcatatcgacgaattctttgaagttgcctttattctacaggatatgttcatttttagataatgctatttttcatatactttaagttctggggtacatgtgcagaacatgcaggtttgttacatagttatatacgtgccatggtagtttgctgcacccatcaacccatcatctacattaggtatttctcctaatgctatccctcacctaccctcctaccccccgagaggccctggtgtgtgatgttcccctccttgtgtccatgtattctcttgatcatctcccacttattagtgagaacatgtggtgtttggttttctgttcctgtgttagtttgctgagaatgatggtttccagcatcatccatgtccctgcaaaggacatgaactcatccttttttatggctgcatggtattccatggtgtatatgtgccacattttctttatccagtctattgttgatgagcatttgagttggttctgggttcatgttttaaaatctcaatttgctccctagtcctaggaatgatcttctccacctccaaggaatgcaagccccagtgcaacatggattcttcctctgtaagaggctagactccaaataatttgtcctgtttttgcctgtgggatgttacaagtgtaccctgctgtctgtaattgtgtttctgaagtgttctatgtaagtaggtttttgttagttgaattgtactttaaatgtgccaatcaagttccccatgaaaagagatgggcacagagactttttgaaaaattaagcatcccaagagaaaagccgatctgaaaagactacatattatatgattccaattatatgacattctggaaaaggcaagactacagagatactgaaagatcagtgtttgccaaagattagagggagggaggggtgaacaggtggagcactgagggtttttagggcagtgaaactattccgtataatcctataatgttggatacatgtaaatatacatttgtccaaacccacagaatgtccagcaccacaaatgaacgctaatgtaaactacaggcactgggtgataatgacctgtcaatataggttcatcaactgtagcaaatgcactccgatggggaatgttgataatgtgggcaaggctacgcaagtgtaggggcagcaggtgtatggaaatcactctatcttcctctcgggtttgctgcgtactaaaattgctctgagaaataaagtctattttttaaaaaatgaagtattccaattaatttataagttttgccacacgtgcaatgacggccctaaccactttactttggttctccgatactgaatatgtcactgtgaatatctcatcctccttgatcccatccccatcaaaactagagattgaaataaggagatgagatggccctccctgaccgccttgtgcctttcagaggaggtgcctgggctggaatggggaggagctaaggactcctgtgggattctgatgctgggtgtgaaactgtctgcagttagcacggtgttggagagatgagtgctagactttgtatttctggggactagtgataaatgctcattattatttatataattttaaagctacgtttaaatttgtccccagtactagagactttaatgttatattgaaataatacataataggctgcaaatagttatattcttgtcttgttgttgtccatgtatcagcattcttgtatgaatgaaactagaaccaagaagaaaatccatcactacaataatggtccatacattaaaacagtttaggctgtctgatggtctggggtgtgtgtgtgtgtgtgtgtgtgtgtgtgtgtgatatagatatgtatgatatatatgatgtatatatgatttatatatatataaatcatctcatcttgctcaaaacaatatcactcttatttaggtaggcacactggaatatgattttaattaattgaaaagtacagtttgtttcacatttgcaggagtggtttaattcctacacagtgtactaagatggcctctcgtgggctcatgatcctggaagatatactcccaaagtgagggggggtctatgttggaagcaaaaataaaaggaatttaaagaatgacaggtctgggaaattattcttatggatggtcagttcttcatatgataaaatagttatgacaaaccaaacaggcacagtctcatgtatgcactgatttgcatgaaccaactttacagataattgattcagttggttggaactacagtttcttccaaatgtggacaacttacaacagggtgggagccccaaactgtgaagtcatgtgaggtcatatacaaactgaaaaacagggtttctctactggaatgataatcctaccatgttacacttttccccaaaatgaaatccaacatctttcacctggcgtaagaagcccaacatgttctggcccctagaaacccttacatcctgcaaagagggactagagcttgttactcttattagctactcttaaagtcacagaggtagttaatttggcaaggagtggctacaaattcaagacatgtttggatgtgctgagaatcagaatccaatctcggccctcaagtcatgggttaaagacttggttttttatctatatgaggtcctaccttgtagttcaagcagaaacatccaacaaatgaaagcagaaacaacatttgacagctcaaattcaaaagcaagaggcttgtcaatgcaaaagtcttgtgctgcaaatgtttcaagggaagtatccatactctgaagtgtgcaattgaaagaatgacctgatattcttgcactgttgcctcaaacaaacctccctcctcctagctagctccggatcttttatgcatcatatagtacatcttcccaaaaaagcaggtggaaaccaaagtgtgcaaaaacacacattttccaagaacaaatgcattatactagcaagttatgtgtggtggggctaggtgcttctgcgggtgtggaggaggaggagagaaagaagggtcaggaggaagtgtgttgggtacagagacatggaaataagaaacaggaaccctgaaagacacacccgcggaggttctgtaactgtacatgtgctcttgttaaatcgccagtttcagaggactcagatctgaggccatatagaaatctattaatttgcatcttgactttggggcttccagtaacagtaagtatttgtatttcaggatccactcagcagaaaggccatacatattcaagtcacataataaattggtgaattccaagtgaattgtgaataccaaaaaagaaaactgattatgtgactttctggaatatgatgtagaaattgacctaacaaaatgtatatgcacacttacggcatgtgtgcatgagggtgtcatttatgtacacaggtcatgtgcacatccaactcatggccatgcatgctgtagcctgttacccattctgggagatatgtaagcctttgtctttctccctccagcttcctgccttcttaaaacatttcactggtcatcaaccaatgattgaagctgggtgcagaaaaggagaaaaggtgaaaactcctcttagtccacaaggtgacgtgttagtgcttcaagtgaaagggctgtggtggagagccagagaaagcccttaggtggaatgagactgtggttcctataggtcggcaccttcctccccacccggcaggtcagctcatcaattgcacttatctcccagctgccacagcctgtctcactcctttctctctcctgttgggctgctaccaggcctggtaaactattccgtagctctgtgcaatagaaaatagatatgtatttctctgaatatagagagggaaattggagttcacatggaatgcatactgtaaacttatttgttttctgaaagcaaaaattaaacttgaaaggagcaaagcttttcaaatttcccatagtgctggcctcaaatcctaaagatttttttccttgacaagaatcatgggatgaattggaagatctggatgctccattcaccacagttgatgatgctaaaacccatgtgacagcagaggaaagaattgaacattctaaagtcccctctggcaactggaatgccaggggagccttcaccatatacctcatcaagccaccccaacaaacctgccatgtcggtgaaaagaccatgctcactatgaaaatgtggcttctgccgggtgcggtggctcacgcctgtaatcccagcactttgggaggccgaggcaggcggatcacgaggtcaggagatcgagactatcttggctaacacggtgaaaccctgtctccactaaaaatacaaaaaattagccgggcgtggtggtgggcgcctgtagtcccagctactagggaggctgaggtaggagaatagcgtgaacccgggaggcggagcttgcagtgaaccaagatcgcgccactgcactccagcctgggagacagccagactctgtctcaaaaaaaaaaaaaaaaaaagaaaaaaaaaaaagaaaatgtggcttcaagaccagaactctagccctttgtccaaaaaaaaaccatagcccccgagacccctgatggccttgacatgccactgggggtccccttatctatttacattatagaagggcttctaagaagaatggtttcagtcagagaatccaagcaacttatgctaaagtccagcctcatcctcagaactctgggcatgcttgtttttaatgccatgtctatccatctgtgactcattaacgcacttagcaaacactgagtgactgactagtctatctctccccgtgataaaatttaaacgcctcttacaagacatgagtagtctacctacctgttacttgtatgccattacctgaaaaattcccatctgtttggatgcaaacttcacagaaactctgccacaaatgctcacgaacaccatcacatgggctgggctctagtgctttggaatatcctactttcttagaaaaatcgatgagtacatataaatataattagctgcaccttgattcctgcggaatcattgtattaactgctttgggctattctccttctttcctttcaggcaatattaatttgtaacaaacacattttatgatataataaattatctttcattttttactatcaaatacatggagaagtaaaaaaacaaaaaacccagaacttctaggcagctcttaaacaagtcttgctgttacttggaaaagtaacaaattcacaggtttattgtctatgttaataaagctgtgttggagtagtcattataaccttttacattccctcctgtttacagctcacagaatatgtttacacatgtgatctcattcagttgtaacatgatctgcataaattatgggtattaacacttgccatatttattacaacgatttccccagcaatttgtcttcttaattgtataatctatattgcaaacagatgtctgcagtttgtatatgcagctatgtactcctatggtttatgcatctacctcaggccattaaactgtaagctcctggagggcagggatgtatctgattcatttctgtatctccggaacccactgcacagctgctgaatggatacacatctagttacttaacctctgtgtccttcagtttcctcatctgtgaaatggctataatgattgcaggaacctgtcttctctgtcccaattgtattaagcaaaacacttaatacaatgtctagcatataataagcactctatgagtgttttctattattattattattattattattgttataattatctggagttaattgaattaaagttcaaaaagatgacctaactcatttgggggaaggtgatgaataaacggcagaaagaaaggaatatcagggatcttatatgctgatcctagctttgtctaatctgccaagctaagtcgtaagatttttctcttttcaaaatacttctgttaagctagtaaaaattatttacttgtaaagattccatgtgctgctttttctgtcataattgcatttaccttaccaaatacatattgaccatctacacagtggatagcagaggggccacagaaatgagtaaagtctagttcactctgcactggtatctcttttcttccatatttacattttataattacatttgtcaaactgcttcacaggcgaagtcctggaccaggaaccaaataaaattgacccagctttccgaccatggaaaactaaaagtataatcaactttggcaccattaaattctgtttcatttattttttccaagagtctattaacattgtcatacagaagtagaagatttaattgagtgtgtgcattttgagttgaaagcagatactaacaagaaaagctaacctggaagacatcttgtaaactgtttcatcagactggaccaggagccaggggagggtcgaggtgactcagggctgttggcaaagctgcagaaattgccactgggtttctctgtcctctaggcaacctaggctgcattggctctctggcctattattcattacggtttagttcaccacagaggttgccagtgagcagtgcataagattagagattttgtaaaaacatgttaatttgtatgaagacgaaaattggactatggagtttagtgataaaaatagataaacagttctgtcatttgatttaaatattaaaataagacaagacaaagcttttaaggaaatgaccacttcttggttctcaactagaggcaatgcctcttctgtcctgagcagatgggtgtttgggaatacgtggggtgacttgggttgctgtgataatgcaggggttctctggcaatcagagggagagggaggggcaccttcaaactgtggtccagatctacacaatcaggaaaggctgttcacctaaaattcaaccttctgttgagaagagcaacacttacggagctcatcaaagaacgacaaaccactggaacagttcttgagaccaaagtctcattcactctgggacatatccagttacataaatcatttatgttttatcccgtctctactttcccaagaaaccctgccacacattcatagtgaatatcaaacctaattaaagatcctaagcagctgagaaaattactcaatgaccaaactataattagtcttctacaagggagaaaatgtattcaaatcattgcttaattttgtttcatttcctcttacctgcacttgaccattaagatcaaaagtctgagaatttgtggccaaaaaaaatgaacatgagtcaaagtcacatctatttgttaataatggaaagtaattccttttctaattacacgtgaaaatactagtatccaacaaacctatttgtggaaaatacggtttagattgggaaggttaattactttcaggtttttcaatgtccaaaacacacctcagaactaacaggctcagacaagatctttatgagatcactggatcctccctccaaaagcttccccctcccctgttgatctctattccatatgctgcttcatttgatcgtatagcgtgtatgatgagcctgaatgcgggcatttgttgatttgagtattacctgaaacaaaagatacaccagaatgtaaaacccaggagggcagagactgttttcccagaacctagaacaactcctggcacataccagatgtaaaatcattgtagaaagaaagaaagaaagaatgaaagaaaggaaggaaggaaggaaggcatgaaacggtgcactattattgtatgccaccttaagtcactcatagaaaatactgcatgccagcactctatgcaatgggtgttacactagccattatgtaaagtcaatgacgggattatacgctgggcactttataatttaataaacacccttcaattaccgtctcatttgctcctccatgccactccacatagtatacgggacatattttaggatcaccagtttagagataaagacagaggttgtgtccccaaagtttgcttgcgagtgtggtatttgtaacttctaaaactctaactctcccctgaaaacacgtcctaagagtggtgaggctcccacgtgaggtggcaatattggttacccccgctgagctcatcacattgcgcaggcctccacagggcagctacactctacgataaggaacatgaagccctgagagtcaggagggagaaaaaagaaaatgaacgtttggaaaagggcattcccaaatcacaggagaaggggaagaaacgtgtctcagctactaagtttctcttttccatgacgctcaaagcagaaaatggctgcacgtgggcaattcgtgcgcttggagctcagacctgcagtcttgtcgtttgtctgccctgtcttggtgcatgctgggcctgacttttttatttttccatttcaaggagccccagcagggcctggaggaaatgagttttgcagcccatctcggcccttgagcttggctcctcggctgacctcggctccccgcctgcagacccggcatgaggcaggcagcaggcactgcggggcagaacttccgggacctgcaagaccagtccgctgccttctgagacgtagttctgaggtgtagcaagttttcattttcacagcataaaaccgtctacaaatacatacttcaaaatgaaatggaggatgcgctcaaaaaaaaaaaaaaaaaaaaggcttagagacacgtcaaaagggcacaggagctcagccaggtcaaataaattcccaaatttgactcacatcacttcagcctcatctggatattacccacactctgcctaggcaggcgaagcttccgtgggatcctctgtctttagtgaattctttcctttatcttgtccagcttttcattgctctttcagaaactgagcccatggttttaaatcttaatatgaccttgcattcaattatatatatacatatatatatatatacaaagctgttttttaaagacaattttaaataagaaaaaaataattattttagataccagagagtggtgaaataataatgattcaaacttaatcctcacttcacgtaggggaaattgactcaaatctgggagcatcaaaaattaagatgcatttacaaatcctaggagaagatatcctttgtaatctcagagaaaataattgagagagggaaaattttttttgaaagacgtggtttggacatattactattttgtgaaatgaagttaaatgtatggtacagatattaaagttcacttaagttttatctatataaagtgtgtgattttggatctaaacaggcataaatatatatatgtgtgtgtgtgtgtatgtgtacatgtttgcgtacgtatgcatgtgtatgtgtacatgtttgcgtatgtatgcatgtgtatgtgtgagcgtatgtgtgtgtaagtgttgtatatgtgtgtatgtgtgtgtatatgtatgtgtgtatataataggaagtaagttggaaaacatgagccaactgacttttttttccttagacagctaaagaagagtggttagaagtttactcacaagtaaatcttttaaggagcgtttacttcccagaaacagcaatgagatcttggaggggcaattcttgtcaactgtgcatcatcaatggagtttaactgtgagaggtaaaacccattgttggtcccgactccaccaacccaaatggtcatatctgaggacttcctgtggttctcccgcccccaccctctccacggcatttactgctcctgtataccctggacttctcgacaggaaatggcaaattcctcagtaggaaagccaagaagtgggaggtcacatggagactggaagttcattgcgtgcagcccctccaggtgacaggcgacaccgcctctgcatgttgagtgcctttgtgacacatgatctccttgtctcatgaccacaggcagcagggtcctgatgagtgccctggagagaactgtcctcccacccctgggtgacacagagtctcagaagccagcagaggtgctgcaccaaaggctcagactttcaccctgcctctcttctcctcaactctttgccctaaaaaacatgtgctttgagggtgtgttgaaaatctcactaagtcaaatgatgcctgtggggcagaaataacccttgctctgaaagggtcaccaaaaagtcatgagactcctacctgtatggaaggtggtgactatatagcccttgtataaacaaacaaatacggtgaaagacttggctccatttttttttttttgtctgttcgttattttttggagaaaacgttgtgataagaagcctttagcctacaaaaatgtctctagattaatgataatttatctcacttttctcagtgaaacagatgaatcaaagaaagtgaagcatcgtagacaatataggaccttcctgataacatctaacatttaataacgtgatcacagcgtggcggctctaaaagacatgcacatgtgaattaatgcatctaacctgcacactagctaccattatgcccattttaaagatgaggaaaactgagactccaaaaattaaataagttgcctagagcatcttgccagttaatgcaccagaattctaagccagctgcctggttccaaagcgcatgcccataaacgcggaacataatgcaccaaatggcctagaactgaaacgactgcaaaaataagtcaacatatgagaaactagagaatatataaagccagccccaccataatcagtggcaagggatgggagatgggaagaagggagaagggaagggaagctaaataatttcagtttttctctgtgcctttaattcctgtcccctgaagatgacacgctcattttagtagcaacccatgaccaagatgcattccccaagcttttcgcacctgacagaaagggactcggtgtccaggactgtgcccgattacaatcaaagcagatggacccttccttagggtagggctgttcttctgacagcctcctctgtgaaactagattataagaggatgtgctgctctcagacaccctctgcctgtccccgccttggggtccttgcctttgccattcccctggtccgcatcactcctccgaggcatttgcaaaccttgttctcaccttttctttgggtctctgtctgacaggccttgcctgatcatgttctctaaactagaggtcccgccccccggccacctggctctatcatgttccctaccttccctcctaaggctcctgacttcctgccacactctgtcttcgttgagctgtgatctatttgtcagtctcccccatctgcatccccctgattgacagcactgagtgagcccagctgtcctgctgctcatgcccctcagcacccatgagcctagtgggtgcccagtaaatccttagtgagtaaatgaatgagtcaatttccacacaccaaatcccaaagggataaaaagacattgcctttctgccatttcttggaagaattttttgagacaaactaaagaaaggaagctacttgttattaaatttttaaaaatctgcctactattttcaggcaaatatgtcatgatgacatctatgaaatctctgaaattaaagagaagcctgacgtttcacaggaattaaatgaagttgctgcatcacaggtgctccctgccacagggctccgtgtggcagcagcaaacagaactcctcgctgcttaggtgtagtccttaggaatgaaaatctgaacgtagtacgttaaaaaaaaaaatcttcaaaagcaaacaaagccctaagtgtcgctgtgtattatcagggcagggtcctcctcagagagaggcgggctgcaatcgcccctacacctttcaccaagtgcctcgcttcaggggtcccattgtctccacgtttaggtttaggagcctggctcttcgtaacaccagcgaaacatgttctcctaaagatgttccctgagatacaacaccactccgcattgtttcaccacataccagcattaatatcccagagtaatccaccctcctcttaacggctgatgacggctccaatggccatgcaaaaatcagttgaaggaaagggaagtcttgtcggaaatgagattagtcttgtaacgagtgttcagccctgataacccatctgggcacagaactgcttaaactggagagcaattaaccttcacccgacaagctctgtccaaccgttataaacattaaagagacagaatccttcccccctccttgtagactaaacaaccagatttgaaattccacgtaaacggcctctttctgcagatgtgcaccaacaacaacgtttagggggaaaaggtgggcaatggctctgttcataactctggtaacttttggccttggtgtgagtgggctgaggttattagcgtaaaaattaactggaggtatttccaataaaatcaccaggtttaggggactggacatagttgctttcatgcagaaacccatgtgtcctataggaacacaacttgatgcttgagagattcttttttcttttctttctttcctttttttttttttttttttttttgagacagagtctcactctgtcgcccaggctggattgcactggtgcgctcatggctcactgcaaccttgacctccccaggctcaggtaatcctcctacctccacctcccaagtagctgggaccgcaggcgaaggccaccatgccccactaatttttctgttttttgtagagacaaggtttcaccatgttggctaggttggtctcgctcaagcgatccacccaccttggcctcccaaaatgttgggatgacaggcgtgagtcactgcgcctggacttcttttttcaacagtagaaatatttgcactgggctagactctcactcactcccaattcctctcttccgacatttgcatgagtgatgctgcttgtggtcacagaagggagattttttttttaatctccgagaagttattggttttcatggggagcaaacctgtgatcttgcctttatcagcatttgccgtaaccagtcgagttaaccaagttgggccatgtgaaataccgagtggttagagaatctaccaggaaacctactgttaaaaataactttcacaacactgaagagaaatagctgaggtcacttaatttatcactcaggcatgagctttctttagcatcagttcatgctgagccattggcttgtttatggacatgatactaacaataaataggtaaagggtaagggccctatgacatagagctggctacaaaccaatgtggggtacacaatatgcctagcatttaaacaagaaaaaaatgtaaagtacatgcagaaagtcatatgagggaaccaaacctctatgttactgacctgttaatgtgactgcaactcagatttttttaaatagaaagaaaaaaggaaaacatatatttagcatgtcctaaacaaatttatctccccaaggttttagtgcaatcttcatgatgacctgagatagctatcaaaatagtccatcctaacattcgatcttatctctcccttgaacccagtttctctttttccagtaggtaagtcataatactccaggcctcagagacgtgtttgcacacaacgaggctgagcctatctcacttataaggatgacatatctcactcatgctggactccagaccggccccaataacagttttggagagtggcatggtagaggatgtgtgttacatgggaagtactactgtaccctgggacaagatatcctggcaacaggtcttgttttcatggtttgcatttacatgcttaactgttccttttcctgcctttgtaagactaagaaaatccttactgtacagagaaggaactgtgaaaatagagcaagtgggactgactctcacattgcagggatatgcaccatctccatttttgcagccaaattagatgcaagcccaggattccactggcctggttctcccaggaacactgggagtttcttggtgtcttagcttgaggtgaggtgaagatgggctatgggcacgtgagctgaccagtttttcatcctgtgtgcattggacgtagacaagggcacacacagacatgacaagaatccatgacctagctcctaatgtaaatcttctttcccaagacaatcttgcagagccctcatggtcagtgataagaggaacttcaatttttatttggaatctgacccatttcataagaatgagtaacacctgaatatttaggtgcagatatcaaagacagaagacaaaaagaaatcatagtgtttgacaataatattagtataggatgccgttttatgagttcagtcttaggactgtgtaggtgcaacgtgaagactttcctgaagacagccacatgaatcatttttcataggatgtaatcaccactgtcatccattagtccaggcttgacacatagaatgggggtgactggctgcctaagtaacaaactccccacgtgtgcttctgacgaactgtgtgggctgccctaagcttttgcatgtctcgacacttaccaagtaaaatgatgagataaggaaaaccacaacatcatactcagtatcttgtgaaactgaaatggttgcagagtaaacactttgccttacagtgattttattttgactattatgctggatttaacaatataatggttaatatccatgctataaagttttattttttcatcaacaaaactaattgcattggcactttcaaaatgttgtttgcacataaatgatttatacttaagtatgagtgtaacaatcttgccatcaggacctggtctgttgggagatatcagtgaatggagcctggctcttccaatgggcaaccgttgtttgttggtgaagctgccacccttgagacctgcctggtctccttcccacctgtagctggctaagtagtgtctccccacaattcacgtccacctggaacctcagaatatgaccttatttagaagtaggatctttgcagatgtaattaatgattaaaatgagatcatagattagggtaggttctaaatccagtgagagcatcctcataagaggctgagcaggacacacagaaacataaagaagaaggtcgtgggatgacaaaagcagagacggaagggatgcatctacagcagtctccccttatccacgggggacacactacaagacccccaggggatgtctgaaacctcagacaggactgaacccaactgccattaactggaacactttctgttccatccacaaatgcaataccttttccatcttaactaagcacttactatccactgtggtcatcagttttgcagtttgaggtgcaacggcaaaacaagcacagatttctttttatttcttcaaacttcaaagacagaagattcattcttactgtacatcttagcaaccacagcatatgatctttttccttgtaagtacagaactttcaccttttcactgaaagaaagcactttacggcttctctttaacatacccggaattgccaggatcagtcctcttgtgccttggggctactactgaataaaagaagggctacctacacataagcactgtgataccgtgacagtcgatcccataaccaagagggctactcggtgactaacaggcaggtagcatctgtagcatggatacggtggacaaaaggggaattcatgtcctgggtggagcagggcaggatggtacaagacttcatcatgctacttagcatggtgaacaatttaagacgtatgattcatttatttctagaaatggccatctaatatcttcagacagcagatgaaactgccagaaaccatggaaagtggaatcgcggataagagaggactactgtccaagccaaggaacacagggcttgcaggcaacccccggagctggaggaggcaccagatgcatccttcctcacagcctccagaagggaccaacccagccaacacctcgattttggatttctggactcccaagctataacagaataaatttctcttgctttaagccactaggttgtaataatttgtcacagctatcctgagaaactggtaacagtacttgtggatgctgtttttaacaaaaattttgccactttagggcactatatggcctttttttttttttttttttttttgccttatagagttaggtcaatttccaaaagtgctggagtttatgccaagaattaagtgactccctggttgcagtggccaaatagcctgaaattttcaaagtaatactaattttgcaaaacttttcatgtaaactcctttgcctgaccatgccctaatttttgtgattaggaaaatctggctcttatcccactggaggaaaagtgtctagttcatattctaatggaaatcatcacttgggaggtgttttgacaaacatctctcagttttgtttaaaaattatgttagaaattaagaaaaataacgaatggaaaacaaaatctaatttttggtatattttcctgctaacatttgtgggcaaattagttaaattatgattgtttcatgcatacttactcctccaacagcatcctagctctcttaggagttccttttaattatcctaaaaacagttaagagtatactgagccaaaatataattaggttgagaaacaatgaactcctaaatgaccaatcaagttttttccaacattttaattctcaaataaaggtcatttccttttatttgactccttaaaaactagattatagttcttctaggagaggaaccaagtcagatttcttttaatcacatacattgccaaatgcatgctttactcagggaaagatttcaatatgcatcatttattcatgcattcattcattcaggaaacagagtagcactttacatgcggacgctgtggaaacaatggtgatatgaattcttaaatgattaaagaaacagtccactaaaaatcttatcaagataatagaatacttcagattttatgaaagattacattttcattggcctatatataatgttttaaccagtaaggctcactaagttaaataatatgctggataatcttaaatttacagaagggttttcagttttactatttggcttagataagctggtagttacttgctaaaattaatctttattataaagcagatcatcttgaaactgaatacaaaaacaaacgtagctattattgaaaatgttatgctatctcatatccattagagatgttatttatataataagtactgtgttgtaatttgcctgattccaatgaatacagaaaccctcagtgtgaatcaatatactagacaccagcagacatatttaaaagattgctacagtttcactgacatttcaaagaggtgactgtagtaacaaaagaagaaaaatgaatagtccctatcatagcacattaatacaacttgtcactagttcatgtccagaaagacttattatataatagattgtcaaagttgaatatttcaatgacccaatgcaaatcctggataaatgctggtaggtgttgctgctcaataaaaatgaaagtggtgtttggttttgctcatcaaggcaagtgtcatgtagcaaaatgcaggctatgggttgcctggaaactgtattcctgcttttaatttacaagtgaaacattcccatccatggcctggaagggaccatcatgtactcggcagcactcattagattctgggcagcccccggtcatctgaccttcccaaacatagggaaaggacgtggatagacattttcccaaaaagacataataatgaacaatgggtatacgacaaggtgcccaatatcactaatcatcaggaaaatgcaaatcaaagacacaatgaggtatcacctcacgcctgttcagatggctatggtcaaaaagacaagaaatagtaagtgttggcgagaatgtgagaaaagggaatccttgcagactgttggtgggaacatggaatgttgcagacactgtggaaaaaagtatggaggttcctaaagaaattaaaaatagacctaccatatgacccagcaatcccttttctgggtactttcccaaagaaatgtaatcactatctcgtaaagatacccgcagtgccatattcattgcagcattactcacaatagccaagatatgaaaggaaccaaagtgtccatcaatggatgaatacataaaataaattgtggtggatatatacaacggaatatcatttagccttttttttttttgagatggaatctcagtctgttgcccaggctggagtgcagtggcatgatctcgactgactgcaacctctgcctcccaggttcaagtgattctcctgtcttagcctcccacatagctaggattacaggcacccacgaccacaccccactaattattaaatttttagtagagacgggctttcaccatgttggccaggctggtctcgaactcctggcctcaagtgatccacctaccgtggcctcacaaagtgttgggattacaagcgtagccaccatgcccggcccatttagctttcaaaaagagattctgccaattgccacattatggatgaatctggaggacgttatgctaagtgaaataagccacacacagaaagacaaatactgcatgatctcacttatatgtaaaatctataacaaacaaacaaacaaagactcaatggggaaatggggagatgtaggtcaaagaatataaagtagcaaatatgcagggtgaacaagtctagagatctaacgtacaccataagggatatgcttaataataccgtgctgtgctgtacttgggatttttgctttaagagtagattttaggtgctcttgccccacaaaaaaagaatgtgtaaccatgtaagatgatggatatgttaatttgccttcactatcagaaccttatcaccatcttcatgtatatcaaaacatcatgttgtacaccttaaatatataaaataaaacttttaaaaaataaatcaaaaagtcatagttcaaaccactcttttggaaaagtatggatttgttaatataagtggtatataacaattgtatatgcatctggggaaaatggactccatctttcatgatataaaaagcaattctcggccaggcatggtggctcacgcctataatcccagcactttgggaggctgaggcaggtggatcacgaggtcaggagattgagaccatcctggctaacacggtgaaaccccgtctctactaaaaatacaaacaaacaaacaaacaaaaaatagccgggcatggtggcacacgtctgtagtcccagctactcgggaggctgaggcaggggaatctcttgaaccccgggagagggtggaggttgcagtgagccaagattgcaccacagcattccagcctgggcgacagagtgagactctgtctcaaaaaaataaaaaatttttaaaaaacagcaattctttgtgattttaatatagggtgccagccacatcactgattcatgcactcactcatgcatttgtcatgcaggaagttatttattcatttatgaaatggacatttactgatagcctgctttttaataggcaccatcagcatgactgaaaggttacatgacaacagccacagaacttaaggcatagaactttaacaacacacgttttgagttactggtcttgacgcctggctaattttttgtattttagtagagatggggtttcactgtgttgcccaggctggtcgtgaactcctgagctcagacaatccacccgcctcaacctcccaaagtgctgcaattacatgtgtgagccaccgcgcccggtcggggttctatagattcttaatcatgattaaccagcaatatgataattcaatagatccctgctcacctcccctaaagaatgtgccactctaagtagttggttcaaaatagcttgactttttaacctctagatccactccagagaacagtggtctctccccattgcacaaacacattcatttatttaacagcatcacccaaagcataagaatgggaggaaacaatgaacgtccttcatttctccaactttaaattatcaaaactactgattttctgggctcacaaaaatgcagttgagttcagctgttgaaagtttggttaacatgtcagttgagccaccaaatggaataacagttgtaactctcttatgttttctctactgtcctcaaaggaatagcatgagaacaaagcaattagcatacattcaggagttgcataatgatgttttggacaatgacagactgcagataggacgagggtaccataagattataatggagctgaaaaatctctatggcctagtgacatacagctgtagtaacactgtagcacaatgcatttctcacatgtttttggtggtgctggtgtacaaacctactgtgttgccagttgtataaagtatagcacatacaattctgtacagtacataatagttgataatgataatagttgactatgttattggtttacatatttactataccatacttttcatcattattttagagtgtactttttctatttccaaaaaaaaaaaaagttaattgtaaaacagcctcaggcaggtccttcaagaaggattccaaaataaggcactgttatcgtaggagatgacagctccacacagattattgtccctgcagaccttccagtggcacagggacaagatgtagagatgaaaaacagtgatattgatgatcctgaccctgtgtagacctacgctaatgtatgtgtttgtgtcttagtttttaataaaaagtttagaaagttaaaaaaaaaatagaacaaagcttattgagtaaggatataaagaatgaaaatatttctgtacaactgaaccacatatttgtgtttcaagctaagtgagtacaaaagagtcaaaaagtttaaaaaattaataagtaaaaaaagttatagtaatctaatatgaatttactattgaagaaatgttttaataaatttagtgtaaatatacagtctttttttttttttttttgagatggagtctcgctgtgtcaccagactagagtgctgtggcgcaatctcagctcactgcaacctccaactccctggttcaagggattctcctccctccgcctcccaagtagctgggattacaggcatgcgccaccatgcccggctaatttttgtatttttagtagagatggggtttcactatgttggccaggatggtctcgatctcctgacctcgtgatccgcccacctcggcctcccaaagtgctgggattacaggcatgagccaccgcgcctggccaatatacagtgtttataagtctacagtagtagatagtgatgtcctaggctttcacattcactaaccactcactgattcacccagatccacagccactttccatcctgcaagctccattcatggtaagtgccttatacaggtgtacaggtgtatcatttttttcccttcttaataataataattattattattttgagatggggtctcgctctgtagcccaggctggagtgcagaggcatgatctcagctcacagcaacctttgcctcccaggttcaagcaattctcctgcctcagcctcctgagtagctgggactacaggtgcgtgccaccatgcctggctaattttttatatttttagtagagacgggatttcactgtgttagccaggatggtctccatctcctgacctcgtgatctgcccgcctcagcctcccaaagtgctgggattacaggtgtgagccaccgcacctggcctctactgcattattactatacctttcccacattttgatacataaaaaccattgtgttaagtgtcacaattgcctacagtattcagcctggtcacatgctgcacaggtttgtagcctaggagcacaggctacacttatagcctgtagcctacgtgtgcagccggctatgccatgtacatttgtgtaagtgctctttgtgatgtttgcacgatgaaatcatctaacaactcatttctcagaactgaccgggcatggtgatgcatgactgtgtagggaaatactttcacccctttagaagaagctataaataaccaggtataaatgcaggattcctttccaaagacaaatactggaaacaaacacaatcaaggaagataattgattacttcaaaaaaacaattgagatatgagagtaaattaaataagaagactgtgactaggataagtaaccaataacagcccataacagctaacattattattattgttgttattattatgagatgaggtattttgccaggttgcccaggctgacctcagatactgaggctcaagagatcctttgctttggcttcccgagaagctgaaactacaggcagctgccagcatgcctggtctgcaatttacatcttttgtacactacagcacgttactgttcaaagcacatacaagtattaagctgcttaatccttgcaacactaccaagaagtaggagttattatcatgactgactctcttctacagatgaggaaacgaggcacagggaagtgaaaggcgtggtgggacagggacctgcggtctggatctgcttcatatagagaaactgggttcttaagaaggaaaatgggccttaatttctaaatcgtaacaagttcagccctcactcctcttttttttttttttttcactatcctggaaaaaaaaaagaagtggatagaaaggtactaataacaatgagtttaatttctcaaattttattattctttaaaaaggatacattggtacaggagtaaagacaaaaaaaatcaaaaaagaatcgagtattcaaagacccttgatggtgtaacatcaattattttaattttgtttttaaaatttttattttctaaactcctataataattgtttttcaaatggggaaaaagaacgaagtttttattactgcctttctttctacaatatattattcaatggagatactgaacctgtatttgctacaggctaaagaaaataaaataaaacaatccctagccaggcaagggagattttcagagaggatgccaacagggtcctatcccatcaggcatccatgacaaatctgtctgctgtctggtcctgtagcatcacccaaatgtggttcaggcagcactggaaacaatacagactcaggagatcagggaagtcattttgcaaagaagcagaagtgtcaggaggtagcacctgtaaggatgaatgctggagctgtctcatggagtttcacagaaaggtaacaagctgcacaatgactgtctaggggcaacagatacataggaggaaagcagtcttcattcaaacaggatactgagattgacatagtgtgtcttccaacaagataagcaaaagtatgtgaagaaatgagtccctaaaggaaaatatctctttgggcaatttcacttcaattcaatttcatgttaaatacaaaatacatatattgaatatgtggataaaatcactagaatatattcgtgcaataacatctacgtgagacatgacagcatctcaccatgtctggcagtctctcggggtcaaatgcaatctctgccccccacctggcagtcatcggcacttatggaataggccaggcagaaggctctgttagatactgccttcttcccttcgcaatgcactgtcccagacttcctggggtgagagaagtgattgtctatgagagctagcttggagtgaatgaaaacagcatttaagaggctcagcattttctgatcgccaaagggggtacccttcaacatgaggtgacccagcaatgattggctgctgagttctttgagtattttagggacctgcaggagatctgggtggagctgtgggtttccgtgtgtacagtgtgtaaacatcaccctttggtgcttcgccagtgcttaaggggctcccaggtgctatttattttgtttagtttattgttcagtgttattgtttgttgacttgatctatttttttttctcctacaaaggggccagtctgcaaggacacatcctgtagatggctaattgatgatgccctattgtttagtgtgtgtgcactgtggttttatttgcttcggttcaaagggcctaaacaatgcattcgttggaatttagtaactgctgtaaaatcagcacagagaacaatctgtgagctgatattttttgtacccaaatctggtaatctctgcttgactaaagaaagcaaaatctaaaatgacctttcaactaaccatagaaaaggccttccattgaatctcaaagagacttatttttctaccaaatataaaaacattcgaattatgcatcattttccatgattcaaaggagacagaggtgcctacggggcatgttactcatagacaagtctattctagtctaatcacgtccccttaaaaatcaccgagtagatgacaccgaggatgagaacgaggtactgtaatcattactttagaaactttatatttttacctgtttcaagacagaattctcctagaaaatctggagcaacaagcttattccccttggagaggagataacgaataatggaccacgcattcggagagaggaagtttccactgggagcccttcctgcatcagtgcgtctctggttgggctggctatctgtgtaggaagtgaacgcaggaagtatctgtctacaaaccctttatcctcaaggtaattgctgtagcagcattttactgtttaccaaagcagtaaacatgtgatctaaaaaaagatgttttccatctccagaagaacaaggctttaaaaaatgtatacatgtgcttattttgtaaccagcttatcaaaattggttacaataggcttgggctttcaacagtgagtccatgaaaacagctcttgggatggacagaggtaccctcacagggatgcacaagaaacaaagaagtggcttccttcactagaatgctatcctagcaacacacattttatgtcttttctcctaagaccggcttaaccgagttcatactgtttggcttacaaagaaggtaaagtcaacaaaactatctatgttaattcaggttggtagaatgagtaattcacaaagtccaataactcataaaagtcacttacatttggccttggacaatattcttatttttacgtgactataaatatgcttccagtttaggagttcacacaagacaaagtgaaaagttagaactcaaaaggagatgtgtagtggctgcttttgctgacttttgcctggcgtaggccaagcctcctggtccgtcttttcctttgtttctttattccagatcaagcttgcaaacctgcaccgtcccagatttcctggggtaagagaagtgattgtctaggagaggcagcttggaatgaataaaaacaggtccaggaaggatccctcagcatttaagaggctcaggaggggtccccctcatcatccttgttgtcttttgtgtttttcaagccgccttccaggtggatagcgattgcaatgagagagaaagagtatggaaggagaataagaagaatagggagacacagaagttaacaacgccctgaatgtctccttccaggacctgctgtgcagtgtccggtgaactcaccagcaagcatttcccagccctgttttaagcaatctccaatgcagatcaggtgctcgtgaataattgggagctcactgtgtctgtcagagttcttactttataatgaagagataaaaacatgttcatcacaggaaaatggacaaattggctaattgaaaacaaaattcaattcacaaactgttgtagaaattgaaaaaaaaaaggtagggggaaatgcttttcatagattccctgattttagtcttagaagaaaaatgtatttggcttgaatgaatagtaaaattaactaactttgattgaggagcttatgtgtgccatatacagttctgggctcttgcgacttggtgaatctcactataaccctgtgaagtaggaactatcactctacccatttcaccgatggaaaagcctatctcctgtgaggctgtggcttgccaaaggtgaaatggccaggaagtagaacagccagggagtgaaccccaaaagccaggtgggagcccatttcccctgcccactgcacgagacccctccccggtttgaagatccgataggggcactgctgttagctccccctgcgtcctggcagcagcacagtcagcagatggtcactgtggagaaggcggagctgaccacctccattttcctataagggagctagggccaggagaggtgcgttcacctggggaagtcctgcagcatcaaactaaagctccgggccaccctctcccagatgggcctctttccacttccccttgccagcagctatatctatgcctcccatccgttgcacggaagataaggccaatcccttttccacagaggctattttaaggatgccacgaagaaatacagagtaccaagtgcctccctgggccaaagataaaagtgggctgtgctctctggattcaaccttcatgtttttgatgctctctggaaggtcagggaaggcacacatatcgtatggatccaaagaggactacgcaatgcaaaaccacatactttttttttctttttaacttggagcaatgtcttgggacatctacctcaaattgagacacaaactaattgtgttgacagattctaaagtgttgtttcaacagtttcttcttcctcaaaggtgagcatcatgtgcacactgtcaaaattaaaaaaaaaaaaaaaaagacccaataaaacccgatgaaacccaaagagcatggagatgagaaactcactgctggctgacgatctgaatgaatggccttggggggaatgtgaatgtggaggtagcagaagggtcctgtcttcagtgcttgattctgtatcaatacttggtaaatttaaaaaacaaaaaaaccagcaagggagattttaaatcatcaaggcagaaggatttaaaaagtggaatgtgttaaatgcaagagtgcgggatctttgcataaagttattatattttcaaaaattcgacaagcattgtttttaccaaacgtgtttaaagtaacagccctgaggttaatgttatgattggattctgatgtggcactttaaaaataaatcattttgcttggccttagcatttcttttcaaaatgtctctgtacttatctgtgtacaacagcagattaccgttcttcccagagtttaattccatgaacaccctgctgaaagacttgttaaggccttatggaaaactctgacctgcgtgttcattattgacgcccaagacgagtgcaaggaagttgatacttgggatgaggaaatttaaatcagcagctgatctggaatctggaagcactgccccttggatctcgccaaatatggaaagaattcttgtcactgagcaaatatagaattcagtgctagagttttacctcttgaattttctagaactttgttttgattagccacctagagtataagaattgctgcctatgggatttttcccagaagagtagataacataaagtaaccagcgataataattttcattatccaattatttcatgtgtctccataacacttaatacatcatgtttctctgcacagtaattcactatgtacagctagggtgaatagcaggaaaaaagagatcagatgataaagagaagggagacagatttgtgtgacttgtataagatacttcgcctctctaatcctttgtccttatctgtaagaaagcagcagtacccaggctgctgtgaggatcacatgagacattatgagagtttagcacaggacttggcacataacaagcagttattaggatgatgttagtttggattatgaattcaagatactacagctacattttttatactttcttaaacatcaatttaagtcaattttaattaacgttattttactaggagaaatgtctctaaaaacataagaattctatttgaagtctacaatgataattacattactctgatatcttaacttcctctttatgatttcaaataattaaaatttaagtttatgttttcaacaagtgcttattgaacctctactctttgccagtcactgttgaggacacagaagaaatggataagatatcactaaaaacagcttctgcgatatcagtgggtatacataaattattcacactcaacaacaaacacaagcaaagctgggagaatgtgctgacaggaaagaaaatgaagagtgggagagtggacagatgggaatcgatgtgaaattttataaaacatgtcttggccaagctcagtaggggaaatatgtggaaagtaagctagaccaaacagagaataaaagtataaataagaaaaaaaatccagaggtcacagtggaccactagccaaaatgggttcacagcaaacaaacaaaaaaatgtaatgaaatactaaaattaaagaagtacaaataaaaatgagattctgttcttatctgtcagaatggcaaagattcaaagagtaaaatattcagagttgttatgggtgtagtgtggaactggtctcatatgtggctagaaaaagggagaactggtataatccttccagagaataatctggtaattattttttaaattggcaaatatttaaatttggcaaagacttaaaaaatatatatacccattggctcaataattcctttctaggcaccaatactaataaaaagtattcaaaaaattaaatagatggtgtactgcaatataatgagtgaaacatcgcaagcagcatcactttatacactaggatattggttataaaatggtaatacatattttagatagaatataatgaaacaaaaattttgcttatcaaaaaatgttagtaacatgggaaaatgcttgtaaaacaatgctaactgagaagagcaggacaggtaggtagatacaaggccaaacagatacacacggtggagagacatatcccaattgttaggaatttgctgtggttggttaggatctgaacaatttatattgactttgtgatgacttttaaacgttttctctaccataagaattttttatgtttataatttatgctaaagaacaagatgtattttttgtaattcaggagtaaagaggagagtggggtattccagggtgctgttcctgccctaaccaggagcacgatgcagtcataggcctctgccctcctccagcagcctcggctcagaacaggacgaagccaaccctctctgaccagcaccacctcgggcgacccctggacgctccacctgcccctgtgtgtggtacctgccctgctacacctttaacaagcacccctgcaagctccctcctccttccttccctgtcctgtggctgcccagacccagatgtaccctgcctgggtgtgggaggccgcacatcagagcagtctatggctgtgggcttcacagctgaagctgggccgtgggaaatgttgagacgagtgagtgcagagcctgaaagacaatacggtagaaaaggttacatccgcgggggggcgtctgatggcatctgccatttattgaggatgggtgcgagacagggtagccattatgatcccattttacaggtgacgaaactgagatcagacaggctagctaccttgcccagggtcacaacaggaaggaagcaaatgcaagtgtgtctgcggccacgtaaggtgagagaagcgctatcaggggtggtctgacagaatccccaggccagggagcagttgtcctctatcctgtggggtcaaaggaggggacaagaaggctctccttgaggtagctccaaagaaaagaccccgccagagcacagtgtgctaccaaacgctggaacagcctggagactgtccctgtctcttctctgaggtttctcatttcagagaaactctcatccgtctggcttccccatggcccttactctgtgattctcttatgtatcagctgttaaaccaataaatccgccaaattgttgggatgcctataatggctttgggtctccactcccacagagggaatcttattctaaagttctaaatgtatcagtcatattttcctgaagacaacagaaatggttgtttcatttacttatttttatgtatgctttttcaagagttgttaacctgtgtttgtgtttaaataaagatctgttttgcaaaacaaaaactttatgagataatcacttataaacgtagataattaagaaatggttcaggctcagcacattgtctgagagcattgcagtcctgcactgtatttcatgggggaagaaaagcccacagatggagccattctcaatcctgctttccagggtcactgagtcagggtgcctggcatgcatgggtgcatgcacacacaggcagagggccagggagaactgtgctgtgtccacagagggcagcctggatcacagagctgaccaagaacggaagcagcaagttgttttaaagtagttgcctgtaaagccacttttcggcaaggacaaacactcagagcatgctctgaaatgacttatgcacagcagggcagcggcattttgcccctggccttccttccattctcccggaatccccctaaagtaacaaggactgacgcaattcgtatttcacttagccaacaggttgatgaaaaatcataaatctgtagctattaaactcattaatcacatccatcaaaattctgtgaggagttaactttcttcatataactcttagtcttaattaagtttccctcacatgtgatagcaaacgttcaagaagtgcaaatgtgcagacgtggcgtatataatgcaagctttatgtctttaaattaataaaattgagtcctatcaggtcgtgtttcaattaccatcaaaccttccaacctctgttaattcaaaaaaaagtaacttctttaggcaagtcatggaaatagcactagggtgccctcaggtctccaccaagccttgttagtaactttccatgtcctgtctgatttttaagatgctttcccctgatgctgctgccggctgctggctctctccacatccttcaatgtcagatctctgtgatgatggaaaatcccccacattccctttttacacattaagtatctttctaggatcagaacttgcaacctggggttcatgttctccttaaaaggtccggggagaggactgtatttctgttgtaattctatgtatttctttttaggcaccagaaagtattattctgagaaaggactgtaggcttcactagacttcccaaattgcagatggcattaaaaaaaaaggaatcaggaaagtctttgggaaattaggctaaaactcctaactgaagcacaatcgagttttcagtgcaacagcaggatccctgcagtctgtagcaaacactgagatgtttgtggggacagtggggccggtgaggttcagcacctctcaatattgtcagatgtcaccaatgcccaagggaagcaccaaaaccaatcagtgaattgtctgcaaaccatcagctttgttgcttccaagtctttactagaactcttaagctgatcttaaaattcacagacacttagagataaatgaacactctcacataagttcccaaaattcctttacttcttccaattgaaacattttgttcccaatttcaagttaccaagggaaaatgatggtaagaatcacaaagactggatacgaatatttagcttttcatagtgtctcatagggtcttacaaatgttaatgcaaaaaaataaaaactccactcaaatgcagaaaaccaacttaaaaaattcagagcatctgatacctaatcgactaattgatttatttactgaaacaacaaaaaaacagagtgcattgagactggaaattgcctctatggggggctgtttcctaattccagtggacagccatcattttccctatgctaacttgggctttgcgctaacgtaattgaaactgtagtcaacagactcaggacctcctttttccactctataaacaaggctgtaaaatcatctcattactttacccaggaaatctaacagaaacatgtcttaaaggaagtcacctataaagagggcctattttaacagaagattaaaaaaaaattcacctgtagtcattctaagggttcacttgggtacatacaataaacacataatgcaatgtaataaaatgttaaatcaagcatagtaccttagacaagtgtaaactattatttccaaaaaagtgttcagaaaatcacaaaatattcaaactttcaaaatagcttcatgtattcataaatgtatacttcaaattaaacagtataacacatttggatgttttgcaaaatgtacctaccttctaaaggatggtctgttatttcaatgtcctttttaatgcactgagttttttgggaaaaaaaaccacataagatcgtacccaagctattcaagatttacacagaatatttgatttaacatgcatatgaataaggatgaaaataagaacaaaaaaataacattttgggtcacaaaatcaagtaatttctattcatgtagctataagtagggcacattaactctcaattttataattcctgtctataggagccatatttcagcagattccaatccttgaagccaaagaaagaaaagtataaggtgaaagttcttggtacacagatttttaatatattattgaacacaccttgagaaataaaagctgaacttctcaaacacagtttctatggtacatatgagtcaaatcttctaatacaaacatttcaaattatgaaaataccaaaccaaagagtatttttgaaaatggcttggcccaattctgggcaaacttccattttcttatgcactttccaacaaactaaaagccttatgaaaacaccaccaaatgcttctcacctccgtgcagcaaaactaaagacatgcaacaaacacaattttcttttccctccactcagcatctgcttttgttgctgatttttcacatttctacaaatgtcacgaaggcatggtggcctttaaaacaactgaacggacccccattcaagactgcatgccccttgacttgtagtcaccattaaattggcttcatttccaggaatcaggccatatttaggattgtacctgtgcagatttacctccacattaatctctacatgctatctactaaaaacttaggcaaggaaatgcatcagaccaaacaccccacagcacagagaaccgaccggccattgctttccaatctccgcaaacctaaccattgctggaagaaatcttactcacagtgcacagacagtaggtattttattgaagataaacatatagtggaacaaaccaaattacccccatttgagttacgtgagcactcagttctcagcgtggatgtcccacaaatcaagtcaacatttgcgtcccattaccagcagccacttgccgagtatctcttcgcttccactgggactgcctggcatccctgatgctaaggagccactgaagagcctccaaatgtctgacattcacaaacgcatcttttgctttgacccgacccttcaacctctccgagtctgctgccttttctcagacacacatccaggcaccgttagggatagttagagaatctgaaaattcagaagcgctccgaaaagcctttccaaaagtaatccacagcactcaacagtgaatttagaaaccccaatttttttctgagtttgaagtttttaagccttgcggatggttggagtaggaaaaaggaaatttactaggcagtgcaaaggaaatcttgttgtcctctattgtggcagtgggggtgttgcccaaccctaacttatctgccttgataaaggaaaccaaagaaaagagtaacaagaacaagattttgtcaaattaaaaggaaccctttccttaccttaatagtgctggccataatgcgatcaagtttattgatcgttaataaatgttaataataattattgcttctctctgaccagaaagtagttttgatgaggttgtttagagcggatgagattgtgctaagtctgggaaatgaagtcagccaatggcaggaagaggtttctattggtcctggctgtccagcccaaagaaacaggatatttgggagtggagagataagagaccctgaaaacaatgttgtttttcttgatgatatgcagccaggagattttttttttttaattaaaaaaagaaaaggcatcaattgggatggggactgccacagcaggtgtgaccggtgtgccgccgtgtgacacactgcactgagaccaaggcaggatgcagatgtgatgggactccgcatggcttcacacgggctgcaagcaccttggagccaaggcgttgagggcaccccactgccctgggtgtcagcccttcgcagcccaattcttcgcagaattactaggacagaggacttgagctcctttctcctaaaaggaaactttgcaggtggagtttatttcatgttaatagatggccatgttcagtaacagccattgcctggctgatttttaacaacctatatttattcaacatttcatataagtgttccagaacagtttcattttctccttccaaatacctgcactttttatttgctctacaacaaagttgttgaaaacgcaaggactctaggcttacagtaaacacaaaaaataaagaggaaaaataaaccttcctaagtcttgttttcaagtatttattaaaacccaaataactgaagtgactacaaatgtcccggaatatcagtgagctggtctcactctgacagacatccatgttgcagacaacagatcctcatagaacttttggctacccagagatgccatgtgagggccccattacatgtctaaaatccaagctataagttcagggtcacaggtctgttttctcctcgaaggaagtacagcgaatgcaggcctgaacattccttagagggtttcaggactttaattactcattttcaggaaattgcttggaagaaacattttgctttgaatctagctacaggaacgcaggacccataaagaggtgtggtctcaataggcgaccccaagaacacaatagactaaatcctgagtcatctgacaattcctggttgcagagctggacgttcagtaaatggatttcactcagactttaggccggcatgtgtcagagttctgtccaccagcccaggtcattctggcttttattatatacctctgatttatcacctcatgttaggacaaaagaaggaggagaaggagaaagataaggggggaaagggagaggaaggagaggaggaggaggagggagggaagagggcgagaaaaaatggagaaggagaaaggaaggacagaagagagagagaaaggaaggaggatgggaggaaggagggaggaaggaaggagaaagggagggagggagggaaagaaagaaggaaaagaaaagaaagagagtatattgtaagaaaatcattctgtggaaatcagaacctaagttctcagcacctacattatgagggggtgttgatttccgctcttttcatctctgaacaatgaataagatggcaggctgattaaaattctgtttccccgaaaatttcaaagtcctgagctgttttatctgggcagcttccactagaattctggagtgcggaggagaaaagctctctcagcttccctgagtgtccttgctttttgttctctcctaagaagcatcaatgtaaaatgttaactgtggcctccacaacacatggcacctgattatgcctttaccaaacaccagctttaaataagatgaacgctttgctaatgaaatagccacggaagaaaatcctgtgtggtcccgcctcacccacgcctcgtggttgctaatccagccctcagttgttccctgcagcaggaaagatcagcatttctactgggacctaatgcttcagtgatgatttggccttaactccctggttcttgcctaatgcaaatcaaactgtgaagagtgggatttcttacctctctattttgaaataatttccaacttacagaaaagccacaagataatacaccaaactcctaataccctttgcctggttaactctgattgtctactggtgccaatgtacatcattttctctgctttctctcacacatgctctctctctctcaatctctgtctctctctcccatatttatttatgtataacatacatgcatgcatatatccatcattttctaactaataaaaatattgttttataagagacaaatttatttattggatactaaaaaagagaaaaacagatgctattatttgatcaatattcgatccataagttttactgcgtctaattttggaaatgcatacaaacataaaaagtgatctaataaaaagttaatttggggatactgagtggtaaattctgttccaaaattttacaaaggaaactcctcctcatttctaatgacaaaatgtttgattgattcctgttgtcttcaaagagaataattcttgatgtttcaaatggcatcatagcatccaagcctggtaatctctgactatttaatgtaaagtgttttaaaaaaatctttggctcttgataggacaaggcacatcttttttttttttttttttttttttgggacggaatcttgctgtcgcccaggctggagtgcagtggcgcgatctcggctcactgcaagctccgcctcccagcttcacgccattctcctgcctcagcctcccgagtagctgggactgcaggcgcccgccaccacacctggctaattttttttgtatttttagtagagacggggtttcaccatattagccaggatggtctcgatctcctgacttcatgatccacccgcctcagcctcccaaagtgctgggattaaagacgtgaaccaccacgcccggccaaggcacatctattaactagaatatagcagtgcagaaaccgtttcccaaatattatcctatggggaaattatctgaagatatagatatcactctagctttcctcacttgtaccccaagtctatgttattaaatggcctcatccctacaccacccagcagcctaagaaccaggctgcctttcccacctgatacctcctctccctagggaaatatgccctccaagccaccacgcggaccaagttagggggcaatctggcacacggcccctacctgaggcccgtcctgccatgagcctatcagggcagggtcctttttcactctccttgagatgcagtaatcaccacactagaccagcacagcccatacagtagctgtggacagcagaacctatgaataaagcacacatttcccttgcatgcttctctgccacaaacccatcccctgtgaatctgccaaaaccttccactagtctcctcacattttactccaaagaaagaaacaaaataatataacataaatataccataaattcactgtcacaataaaagaaacactagtatttatttatcctaaaatcatttcttcccattttctaaagatcgaacaagttctcattcttgttcccttactaacttctctgtatggaatatggggaggaaggttaggagctaagaacactctgaatgacagccacatggttctcaatgtaatacatgcgcagagcaaagagaggagatccgtctgaacctccacatctgtggggacacaacagaagattcactcatgactcattcacgtctttatccctgccctatacatccctacaatggaacgcccttcctcctcaaaaacattgcaggaaaatgatgtcgtagatgaacacttagcaatatggaaaactgctctgatattttacctggttagttaaaaaatcacagtatataggagaattatatccatagactcattttgttaaaaataaaaaggcagttggggatggccgtgcattctgttccaaagcatctgtgaacctgaggaatagacaccatgagcgaagctaaccttcccgagttgaaaaatgaaatgcaatggtggcagacatgtccaaggaatattatggggactcgatccctttatgaatcttgtcatagatgaatgtgtggagatgtcaactagttggcagcagaacagtattggaacggtggtaatacaaggaaatagtatcatcatattagaaactttggaatgagtataaataatggctgttcaacagaaaaacccatgtcccctctccaaagggcctgtttcactatatgtaaaaattaggtcatgtatgttttcatattagactttttgttaaataaccttttttttttttttttttgagtctcactctgtcgcccaggctggagtgcagtggcgtgatctcagctcactgcaagctccgcctcctgggctcatgccattctcctgcctcagcctcctgagtagctgggactacaggtgcccgccaccaccctggctaattttttgtatttttagtagagacaggttttcaccatgttggccaggatggtctcgatctcttgaccttgtgatccactcgcctcagcctcccaaagtgctgggattacaggcgtgagccaccacgcccggccaataaccttttgtaatagtcaaaaaataaaaaataaataaaaaggcaaagtaaaaatattgacagctatatcttataataccaatggcagagaagctttttgttttttcccctcttcttctttggttcacttatattttcaaaacataaatttgtaataaacataaattatatcctaatataaaaatatgtaagtaacatgcaatgttgttcatttttgtaaatatctgaaaaatacaggcatgttctgtaaaaagtgcagcccacaatacttgtaggtgtcaaaccttttagcatgcccaaatgcctgttcttttttaaatgtctacagcaagcatagagctctttttttttttcattttattaagaaaacccagaaacgctcaagagtttcgtggaggccatctatgcggcattaatccattcaggtgatattaatggccttttcctgccaggaactccagtgggcactcaggaagccaggattacagggctctatccagtcaccgcatgtctcggcattcgggaagcctatctcagtctcctcaaattctgcacacataaaacttcagagcctgggagcgacccatgaaacgcaggtttttaaggacaaaacaataggacaaaagtgctgtatattgtccttaagatgacacatgaatttaaaatgcatagtgtttggattattcatgagagccccgcaagaacgatgtcccaggggtttttgccaggaacatgcctgagattgtagataagaatcaagcatctggggctgccgcacaatggaaaactccagcactccatggaacttttccatctgcagcagtcggaggatttgcctgagaacatacgcggcatgaagacactctcagccctcaagggcacccagtcagcgctgtttaaggacggtttttctgttcacagcatacttcatgattacagcttcactccattggatacaactatgtgagtatgtgtgtatgagtgtgtgagtgtgtgtatgagggtgtgtgtgtgggggggtaggggagtgccatatcccccagcagcacattaagaaataatccaattacaatttaaataaccattgtttcaacactttctctaagtggtgaatgtattcttcagtctcttggttgatctgaactaatagaaaccaaggaaactgttatcacataccaaatcctcaacttctcaacaccaagttgcaatttccttaatactgaagcacacgtcagttcagttctataagctcccatggagcaatgatttcaataaacacaatttcataagcatcccacacgttctcaagtttaggccaattttgctcttactcaactccatatgactttaaaaatgcaggaatattaaaaccattatcaaggactccaaataggtcaatgtattatctgtggttttaagaaagaaacctaagaggagagtaattattttgtcaccattatttagcttaaaataacttttaaatgtattgttccaattattaggcttctccatataatttggaaaccattaaatgagtttcaacttctttgtccgtataactgggtatatctgagcatagatgctacagacatcacgttgccattggtgcccataaggcttcgtatgcccacagggcatataattaagattcacaaaagcatctgactggcatcccactctacccccgactcagatccaaagtatcctttcccaggtactgtcccctgtcaccatccttggccaaattgagaatttatcccaggttgttgaaattaattttgattttgattctagtcagagttttaaatgattttttaagaagtgtgtcaatctcacctataagatactaaacagcatcacttatttttgtcttaatctgtcactattttatgaattatttttaaagaaaatacagattacttcttaaagaaagatcataagtggcactataatagcattcaattgatagaaattgatgtagaagcctgcattaataatttttcctgctgctttctaaagttggcttttagttttcggttgaggtgggctttaattcagcatcacctcatttgatgatttatttactaatttatttccatcacaaatggaatcagaaatgaagcgaaggcaaaaaatctttgccacaaattcatttatatttgcatgagtatcaccaggctacctgcggatgcaatgaagccctatacccgtgcctgaagtcaggagcacaggacactgggagtctgtctcagcgcagtaactgctacatggtacgctccacatggtatcctctccacctgagccctcctcatccctcgccccctctccacacctcaccctctccacactgtattatctcccactgcaagcaacgcagaggacacagaggtgcagctgaagtgaaggcaggccagttcttttccaattcactcttatgaaaatgtgttaaatcccgttaaatgcaccgacctgaactgaaatgatgatatcagtaaatttgttgttgtcatctgatgcccacacagatctcagcacatgttttgggaaaggctgcagtgttcaaggagtactagaaatgttctttctgagtggactggccatgataagccaaagaatattatagccgatagggataaatcatggttttcccactgcgcggttgcctggtggagattattccagcctttatttacagctacaaaaataatcctgcctcaaggattttaggaagcaaccacctcctgcctaaagaactacactgcattgttgacttgccagctagaaaccagacatgagtcgtgcagggaagttccctttgaacggcttgaattgttgtcactagagggtgctaaatgcccctcaaaaaggcctttagagagaatactagtgtgcctaattcttgatttaaattccttgaattgacattattttacaaagtggtctcattttttacttgttaaaattaagatctaacatttataatgcagaaatggtgtttttttttgaaaaatttggattgttcattattatagaacataaagaaatacacgttttaggagcaaacatgaattacacagatctgaatataagattaaaggcataaatctgggggggtgagatttgtccatggaaattgtataattgttttatgccactgttaatgattttaaagcctgaaaaatttaccactttacaataattttagattgttcaatatgttcccaaatgtgagttgcatcaaattcggtaaatgtagagtatgtttgttttctctgtacacaatactgacgtcagtgctagtgcctgcctaaactcagacaccagtagatccttttccagaactaagtgttataggaggaatatggattatactgtaatatatcagatgtgaaaaaagcctcacggtcccttcctttctcaaaaaaaacgtgtagtattttggaatatgcatggagtatagcacttctaaaaatggtactttatgtatatatgaagtaaaataggccttaaaacttaatatacagatttccttgaaaataatcttattatacatttacactgactttttggtcatccaaacattatgcacttaagcaaaaagaaatataaccaattttgcaactttcctcttcctgcctttgcttctacttaaaaatatctgcagtatttccttttctcgccgcttccactttggttcatataccaaggaatcgtgaggtcaatgggtgacagttgtttgtctgtgttcacggctgtcgggcggggctgggtgtgggtaaggctctgaccgacatctgaagaggcttcacccactgcggtttaggatacattttcctctcgctctgccagtagaacagggaggctagttttcaatgtgttctacagaaggataattaaggcagtgtgtcacctgctcgtctgctatttttaaaaggaaacaaacataacctttgcatgtgagaggcattgcaaactagatgggaggaggcccggaccctgtaacagtcgtacattccggtcccagcttcgctggggtgcaactgcagataaaagacgctggctcgacaaaaagcgcccctgggctctgcattgccagcatgcacaatacgaattgctaatgatgagctggcttaggtaggaactgaggaccctgagtgcagggctaacctctgcttcacaggaggggtccactggcgcgcgctggaggcggggagccttcgtgatatttctccgaagggaagagtccatgcagcatcctgataacagggaccttggcttcatccccaactgctcggtgaccccgatgcgtcatttaattcatttgtgccaatattcctttttcaatcaaccagtaactttgcaggtttgttcaaagaagaaattaaaatgcattggagatggaaggcagccatcttcccggagccccagtgctgacactgggaggggaaccccaggattccctcatgactgtgtcagtgatggccctcaacaagcacttactgaatgagtgaatgaatgaatgaatgaatgaatgaagccggccacagagcccaggagtatcaggggagagcaatactggctgtgtcagtggctagtccaggagagcccttcaagagcccagagttcgacttgaacttgggactcccctgggatgggtgaggttctctcaacagcagttgacaggagggaactgggacaggcccagccagtttcattcagtccagccagctgtggctcctctttaggaatgtggccaggcccagctgtggccaaagcaccagccagtccctcagttctgaacagaacgtgcccagcatcagtgccttcatttgtttttaaactgcctgctgaccatccacaaagttaagatgacagctgggacttaagttgtgaggaaccagtggctcccccatcactctctctcacacacacgcacatgcacacacacagagacacacagacacacacacatgcacacacacagagacacacaaacacacatgcacacaaagacagacacatataaacacacatatacacacatgcacacacatatatacacacagacacacaggcaaacacagacacacaatggatggtatcgatatctatgaacagatgagagagagagacagagcaggaggtcatctgctccccacccctcttctccccactgtcaccacctctctcccaagtctagctgcaggccctgtgagctgtggaagtggcttttttaagctgtcttcttagattgagtcattgggcagtgaggaaggtaaattttctctaagaagcctcccaaatctgtatcttatgggatttccgtctcaataattgagctaatagtacctgtaagcaagtggatagtcaataaaaaaaaaataccggctgtaagaacgaatgaatgaatgagtggatgagtggatgagtatacatcctctattttgctggcatcatgattattttacagcagatttatctggatttcaatataaaataagagctcccatttgtatacaacttagtccttgtaattttccaaagtaactctgattaaaattatttccagccaaactatttaggcaactgggttggtttcacacgtacttatcagaaaccattagaatggtatattgattgcatttctagacatttgccataccaccatggcaactgtatttcccaagatggcccagtaggatgtcccatcatgcataaccttctataaagtgacattgactttgcttccatcagaaagtgaggtccacgttcccactccttgaatctgagttgggctgtgactacagcagaagttcagctatgtggcttccaaggctaccttggaaaggtgatagagcttccacctgattttcttgggaacagccactcttaaacctcagccaccatacggggagaaagcccaagccatgtgacgaggccatttgtaggtgttccagtcatcagtcccagcccacagccagcattaacccccagaggtataaatgaagaaaccaagatcactccagccccaaccggcacttgactgcaaacctataagagactccaagcaaataatatctatctcagcccaatcaagccctggaaccatgagagattctaaataataaagtgatcattgtgattttaagccactgagtcctgcagtgagttgttatatagcaaccgggcatcggcataccatcagaagattccttaagaagaaacttttgcaacgttgctacagcagaaaatattccttctgtatgatcattcatccattcatcaatcttgattggcattgcctatgtgctaagcattgtcggtcactggaggtgcagaaaagaagtgaagcagtattcagccaaacaaacaacttgcatattggatagagagaaaaatatgccaaaattacaacagtattttgacccaacagaaaggacataagaagggaacatcaacagttccttcctattcttttccaccctttttctttctaggctcattaaatgtagaggtgcctcagggtcactttgccccatgagagtagataccctcctctcccatccctaactttggtcttcactctatgcctgataccagcagctccccaggctcctccatgctgttggcaccccattcccattctctggaaacatctcagcccatcaacctcagattactttcccaaggagatgtgagaaaacttcaattttcccctttgtgacttgcagagaaataggggtggtaaatgagaagcagagggagagggtggggattcattaccttgagttactaaagagaaaagctctagtgtttagaaggtgctgttattattttctctgaaacattagctcctagaaatcagaggctctgtccctagcatggtctctaaggcttccaggacgccccaggggcttccctcagtcaattttgactctaatgagagccatctggaaggctgcaatggtgggcctggctgatcactggaggggccttcgctgtgggcacagggacgtgcacaggttcacagagtgtgtctccgtttctgggaaccatggtcctgtgtgctccttccccaaagaaagcaggagaaagaaaaaccacagtcctgagtgggattctccccaaacatctaaaaagcttctttaaagaagtcaagttatcataattaaactcacatatggaatgcctatagacaacgtgttgctcttccaatcccagggagctaggacacccaaaactcacctcccagacggagctaggatttgagatactggattccacattacttaaagctgttcgagcttttcatcaggaatggaaagcattaatgcgtctcacacgtcactctctgtttcatggaattcttacactggggagctctttttattttactatttttctttaacagccagaacactgagaagtttgcaaagaaatttttcagctgcctttagtgacccttaactcaagaggttttgcctaatctgtaaattggagttgaaaatatttcagtacttttggagtggggagctttttgtctttaaaagagtggaacgacactaacaatagggctatacataccttgtgcttctttgtcagttactgcaaaccaaaaccagatgtgaagtatcagcggctacctcgtagtgacccatggaagttgaggctaatccatatcattcttaataactcaaaactgccaccttttaaccacctaatttttttctcacttacaaatgcaaaaaaaggaattgacagtacacattgaaatcgattttcccctgaccacttacagattttctcctataagagccaggaataaaagctcactccattatatcaagcagccatcatctgagtatgctttagtttaggtgatcatcacctttaacaaaccaagatctggaaggaagatttctgatctttaacaaaccaagatttgaaaactagatattcctgtcatgaccttttcccaacattcagtatgtaagggattcactggattattagactgcttgtaaatgtaagaaaacatagaaggtttagtgtgaaggagttagcaacctaacaaatgtttccccctgaattttcaataaccttcctgaatttaaaggtaatgaatataaatgaagaacaaaatcaatagatataggaatgattcacaacctcccaaatgaataaatcaatcattccaccctacatttgaacattcaatcaatattttgtctatttactaaatctaagaggaactactttaacataaaactaaatatgaaattatttccagcattgaatattgtgttttgccttagagcaggcacaaagtggaatgcctatgggtacaaagctaggcattgattgatgtttaatacctacaaatacagcaattacactgtcatgctacacgagacttcctattcctacactgaaattagactgcacatatgtagggataaaagataagacacaatcatatcatatttcctcaaatctaagactttgggtggtaagatgtaaagcacatcatgatttaaagtatcactaggaaagaaaaaacaattctgccaatgaaaattcaccgtaatactttctaatcaatcaattttaagatacatcccaatttttaagcaagaataaatgtgttaaaattaacacaaattggtacacttgtgatacaacagaagcactaaaatgtcacagcaatagaccacagggtttctcaaccttggcagcatcaacattttgggttggttaattatctgttgtgggggctgccctgtgcatggcaggatgtttgctagcattcctggcctctacccactagatgccagtaacacctcgcagactccaattatgacaaccaaaactgtctttagacatggccaactgtccctaaaggtgcaaccaaaaactgtcccagttgagaaccactggaacagagcaattcggttttatcagccttgtaatataattgtgtgtgtgcactgtgtgcatgacagactgtcagcctaatggaaggtatattgtcagatgggatagattgacctgaaaaaatcacataaaccaacagctggtacatatacaagagtgtgtcctgcccatcctaacccacacaatgcaaaagaacctggatgaccacgagtcaccatcacaggagtttactatccataagtgtaaaccatccaagaaaagtgaaaacagattaaagaaaataaaaataaataaaccaccacacaatatttgggcctagccagataacaacaatgaaaaaatgtaatattttgaagtattggcaagaatgtggaggaaaaagcattgacattcgtgtataatgggaataaaataatttatcctttgtctccgcaattgatattctagaaatctattttttagaaatactcacaatagacagttataagtacaaaggatgtctgctattacactgctcagtaacagtaaaatatgaaaatacactgtacgtctttcaatcagatattgaataattatactacacagtattaagaatgagatagatattaatgtactgcatagaaaatattcaaagtataataagttttagaaaattatcacatatgtatattagcatatgcagagaaaacatcttaaaatacaaatttcagttttgaggtttggatcatggagtaactgcccccttttcaagtcaaacagttgagaaaatttaggataaaacaagtgtgtgctacctttgtaatcagataaagtattttaaaataattcacattataatatagaaatactgaaatgccaagaaaatttaaatatattaattaaaacctacgggccaggcgcagtggctcacgcctgtaatcccagcactttgggaggccgaggcaggcggatcatgaggtcaggagattgagaccaccctgggcaacatggtgaaaccctgtctctactaaaaatacaaaaattagctgggcatggtggcgtgtgcctgtaatcccagctactcaggaggctgaggcaggagaatcgcttgaaccagggagtcggagggtgccgtgagccaagatcatgccactgcactcgagcctgacaacagagtaagactccgtctcaaaaaaaaaaataataataataggctaccaattagactttatagaatacataaatatattaatatagctacaaagaggttgaagcttattcattgagacaagagtatttattgagcatcgactttattaaatacactgttagtaagataacaagtgaaacttgttaaaaaaaaagaaactaggacaaaagaaatttgagttgagttccccaaaaacagggaatattcagattgtaggggaaattgggtaaaggatttgtttcagcatgaaaggagcaaggagcaaagaaactaaatgggaggttatgctgagaagtatatcagtatgaggaaatatcttgacatctacagacaaatatttgttgccaattcattttgggcattgaggattcacaagaataattaaaaacacgtaatataaaatccttctgattagagcacattttatggcactgcataaagagatggctgtgggagtcatttatattttaatactaacttgaacaaggcttggttctgcaaataaaacagaagagtaaatatgaagtggagcacataataatgttactgtttctgtgggtgagcttccataggaaagaggcaaaggcatcaatctcaaaaagttagaaaaacccaaagaaagaagaagaaaaataacaaatgagaacaaaattgagaaaattgtaaataatatggtagagaagataaacaaaaccaaatctggttctctgaaaagattagttatgtgtaagtcactggtgattacagagagaaaagagggaaggttaaaataaccaaagtcaacaataaaaagggggctattactacagatgctgtagacattggaaggataatagaatattatgatcaatttcctatcaataaatgtgaaaaattagttgaaatacataattggaaaatataatttaccaaaactgtcaaaagaaaaaacacaaaacctgaactcctataattattaaagacattgattgaaaaatctcagacctcttaaaggacaactccaaaaataaaaaaataaaaaaaagaaagaaagttccaggccagacggatttatcagcaaattctaacatgcatttaaaaaaaaaaggatgccactcttacataagcttttcagataaaagaaaagaaagcttgataccaaaatgtagctagaaaattatttaaaaaggaaaattatgggtcaatttcatacataaacatagatgcaaaatcctaaataaaattctagaaaacaaaacccaacagtatatacgacaataatatatattgtgaacaaactggatttattttaagaatgaaagcttgtttcaatcaaataatcaaatttacattgtaaagaaaatttatataactttaaacaaaagaagaaaagcacttaataacattcaacattcatattaaaaattcttagtaaattagaaataaagaggaagtttataaatcctacaaattgataaaaggaatctaccgaaacctacagtaaaccacacattttcatgtcaaaactttaaaatttaatcatttgaagttgggggaaaagacaaagaagccccacatattaccgcatttgtctgaaattgaattggcagtcttagttagtaaagaaggcaaggaaatgaaatgcaatgttaaaggattgggaaaaagtaaataaaactttatttacagatgacatcatttttttacacagaatttccaagagaatttggaaataagtcattagaattaataaatgagttttaaaagtttgctagatacaaggtcaatatagaattttagttttatatatcagcataaacatcaatagaaatcaaaatttttaagtgatactgttttcattagcattaaaaataccttacaatatggacataaatctaacataatacgtgcagaacctctacaccaaaaactacaaaatattattaaaagaagaccaaaataaatggatagatatattcatggattgaaaaacttaataatcaaaggtagaattttcttcaaattgatcaatagattcaatgcagatgcattcaatatttcaacaaagtttttgtgaaacttgagtgattctaaaatatgtatggaaatgcagagtcaaaaacagacaagatgctcttaaagaagagtgagaaatacaaaagattatcagagactattacaaactggaaaacctagaggaaatggatacatttctgaacacatacaacctgccaagattgaatcagaaagaaactgaaaacttaaacagaccaataacaagtaataagattggataggaaaaaaaatctcccaacaaagaaaagtcaaggaccagatggtttcactactaattctaccaaacttagaaagaagaactaataccaatcctcaccaagccatttcaaaaaattaaagaggagagaattcttcctaattcattctatgaggccaacattaccctcataacaaaatcagacaagaacacaacaaaaaagaaaactacaggctgatattcctgatgaacatcacttcagttcagcatggatacaggccaatatttctggtgaatataagttttctagtattttgttcagcaaaagctatcaacaaaatattagtagcctgaaaccaacagcacatcaaaaagataatgcaccatggtcaagtgggatgtatcccagagatgcaaggatggttcaacatacacaaatcaataaatatgatacatcacatcaatagaaaaaaacaaaaaccatatgatcatatcaataaatgcagaaaaggcatctgataaaacttaacattgtttcatagtaaaagctctcaacaaactaggtacagaagaaacatacctcaatatattaaagtccatacatgattaacccacagctaacattatactgaacggggaaaggcggaaagtctctcctctaagaactggaacaagacaaggattctcatttttatcacttctattcaatataggactggaagtcttagccagagcaatcaggcaagagaaagcaataaaggtcatccaaactggaaaagaagtcaaattgtccctctttggagatgacatgatcttacatctagaaaaacctacagactccaccaaaaaactcttaggtttaattaaaaaattcagtaaagttgcaggatacaaaaaaatcagtagcatttatatacccaataatgcactggctgagaaagaaatcaagaagaaaatcccatttacaataggtataaggaaaaaatatctaggaaaaaaattaaccaaggaagcgaaaaatctctacaaaaaaactacaaaacactaatgaaagaaatggaaaaggacacaaacaaatgaaaagacactgcatggtcatggatcagaagaactaatatcattaaaatgaccacaccacccaaataaatctacagattcaatgcaatccctgttaaaatattaacgtcatttttcacaagaatagaaaaaaacaatcctaaaatttatatgaaagcaaaaaggagcctgaatagctaaaggaaccctgaacaaaaacaacaaaactgggagcatcacataacctgacttcaaaatatattacaaggctctagtaaccaaaagagcatgatactagtataaaaacagacgcatagaccaatggaacagaattgataacccagaaataaatccacatattcacagccaaccgactttcaacaaaggcatcagtaacatacattgggaaaaagacaccctcttcaataaatggtgctggaataattggatatccatatgcgaaagaataaaactggacctctatctcttgccatatataaaaatcaactcaaggtagatgaaagacttaaacttaagaccccaaattataaaactattaaaagaaaatagagaaaacatttcaggacattgatctaagcaaagatttgatggctaagacctcaaaagcacaggcaagagaaaacagacaaatgagactatattaaactaaaacacttctgcacagcaaaggaaagaaaacaaccagcagagtgaagagacaacctgttgaatgggataaaatatttgtaaactgttcatctagtaagagaaaatccagaatatacacaaaactcaaacaactcaacaattaaaaagaaaacttttacaaagtgggcaaagaacgtcaatagacatttctcaaaagaagacacaggaatggccatcaagcatatgaaaaaaaatactcaatatcactaatcatcagggaaatgcaaatcaaaaccacaatgagatatcatcataccttagttagaatggcaattattaaaaagacaaaaaataacagatgctggccagaatgcagagaaaagggaactcttctacactgtgagtgggaatgtaaattagtacagccactatagaaaacagtagagatttctcaaaaaactaaaaataagactcaatataatccagatatctcactactgggtatttatctaatgaaaaagaaatcagtatatcaaaaagatacttgcacccacatgtttaccgcagcactatttaccatagcaaagacatgaaatcaacctaaatgtccatccacagatgaaatggtaaacaaaatgtggtacatatacacaatggaatactatttggccataaaaataaggaaatcatgtcacttgcagcaacatggatggaaccggaggtcattatgtcaagtaaaataagccaagcacaaaggacaaataccacatgttctcactcctatgtgggagctaaaaatgttaatgtcatggagatagagagtggaatgatggttaccagaggctgagcagagagtgggagtggagaggaagagagtttggataatgggtacaaacatacagttagatagaaggaataagttctgatgttgtatagcagagtagctgactatacttaacaaaaatgtattgtatagttcaaatcagctagaaaagaggacttgcaatgttcctgacacatagaaatgagaaatacccaaggtgacagacaccccaaaaccctgacttgatcattacacattctatgcatgtaacaaactatcacatgtaccccataactatgtgtgtgtgtgtatctatctatctatctatctatctatctatctatctatctatctatctatctatttatagtatccatttttaaaaggcaaatcttaaaaaaaagagtgaggtaggacaacctgctctactaaacatttttataaaggcacagcaattaggtcagaatagtgttcatgcaggtagaaacaaatcagacaatggaaaagaaaggaaagttcagaaacagattcacacatatatggacacacttgatttttgacgaaggtggcagttgatttttttttacaaaggggcagagtagttaaaaaagggagaaactgttggtaaatgatgctggaaaatgagaaatccacatgagaaacagaaacttgagaagtaactcataacatcacaaaaattgatgtcagataaactataaatctaaatatgacaagcaaaaactatgaagtttctggaacataatatagaaaactatattcctgacttgggaagggaaagattttaaaaacaaggcacagaaacactaagagtaaaggaaagactaataaattgaactgcattaaaataagaaaaaaattaggaacttaaattttcatcaaaagacactattaagagaatcaaaaggcaatgcatggagtggaagatgatatctttaacacatctaatctactattcatatccagaatatgtaaagaacccccatcaatcaataagaatacacacaagtcagaatacacacaaggaaaaacagggaagaaactgcacaggcagtcataaaagaggatatccaactgctcattaaaaggtcttctacttcattagtaaagcaggaagtacaaattaaaacctgaatgaaataacaccacagatacatcagaatgtctaaaacaaagactaacaatgttggtgaagatgtggagcaataagaactctcacacacagctggagtttaaaaaacatccttatttatccatcagggctgtaataagaggcatatagcatattcaaataggtaagtgaacaaaatttaatgaaagaatttacaacggtaaaggtagaatttagtaaaaaccaaagggtgaggaagtcccccaggctagcaagaacaggaagccattactaccctcaggcctacaagggcaagggaggtagcagtcacgcagcaccggtagctgtgaacacaggagaggataaacaataggagctgtggccttccatggagggaaaaagtcactgccaacccatgaccaaagagagaaagctggagaaaaaaactccccaagctctctcctcctactctcaggcttccttgtggtgactctcatttgcttaacccaacagaagatagaggacaaaggagcccatttgatgtagtcgacagaagtcaaactcccaggacaagaggagcagagaaggatggagaatgaattagagaagtaaacaaagaaagtcggcacatctactgtcatcaaagactgtgtaattccactatttaatacatgtacaatagagatgtgtgtatatgtgcaccagaagtcacctacaagaatgtccactgcagtattattctctcagttaaatgctatatctggctgcacaactagattaggactgagaccctaaccacacatgtagaagcagggagaaagatgcagttgagaagccctttgccatctgatatgcttccaaacaagggaaactcagcttggacactgaaagcattttgtataaaatactgtttgtatgatatccccatgtcaccacacacacacacatacagacacacacacatacacacacacacaacaaaaacaaaaaaaacttccagggttacttttctcctcagttagcaggtcaaaacttttcacgtgtgaaatacttttgcaaggaggcagatgaaacgggggagaagggataaccttgccttgcagtcatctatcaattcactgcaaggaaggaacacagagcttagatatgaagcatcaggagttcttcccaagacccttcttgtcccttgggaagagccaggagctggaggggatggccttcactgagaagtggcatcaaattagaacctgcacaacaaataggaaccagctacttaaagatccagagaagtagccctctagactgaaggatcagctcctcaaatatcctttttgattttgaactcacaagttcaggggcatccgaggaacagacacaagccagggctgaacaatctcatctgtgtccatgaggtgggcaagagccagatcctactgaggagtttgaacttaatcccaaacatggcgggaagccattggggccaaagatgaattagggattgtctgatctccttgacacgttctgaaggttttgtgtacagaaaaggtttgtcaacatgcacaaaggaaagctgggataaccaagctaagacgctaccgcatcattctaggggacgggtgactcattccaggagtttctgcaggaagacctatcaggactggtgattgactggaggcagagagcacgaaaaaagaacaatcagagatgatctgtggtttgtggttgttgtgtaatgttaaggcttaacaactgcgaaaatagtgtttttactttacagagaagaagacttgaagaatacaagattggggagagcagatcgggatttgtactttatatcagacgtgctcatagatatacatgttgagatatcagttgggagctggatatatcaggattcgagactgggaatcaccagtttatagatggtttttaagccatgtgattggatctcatttcttagtggggagaagtgagataacaaataaaagccaagattaaagctgaaccttcagcctgcccatcacttagaagcccagcagggacagaagagccagccgacagcacagagtcgaggaggaggatttccgggcttcagtgagtgtgcatcagagattcatggacacaacttaaagtaagaccagccacacagttcccttcattttctcaagcaacattcagcatctcaaagtgcggctactacacacggagccaagccctggtccagttatcacaaaaccttactagatatgtcgattattagctgcattttatagctaaaggtaggcaggcacagagaagttacgtctcttgcccacagtcacagcaagcaaacagacctcagaccaaagtctttctaactccttatttcacatctaaaacactatgtgacgccacctccaaaaaatgtgggggttactctaggacaaaagaagctcatgaaagcaaagagagaagcatagagcttaaatttagaacaatattcagggtgattgggaaaaatagcctccatacaaatataatcggttcatcaccaggtgaataaaatgagagaggaacctggtacaagtgaagttcattgaatttgcttgcaaaaaaacataattcaagtgtggaagtttggaaactaaaatagtaatcagctaaagaaattttcaggccaacttagacacaatggtgacaaagctcccctgaggagacaggaactatactacttgcaactctaactgaatggacttaacttagcaattaagatcaccgtaagtttgatcagataagtattaaagggtgtcttgggtacatttgcagattcagacactcttagttgtgaaattcttcaccaaaaatttgcaacttatggcttgcacattaaaaacatgatatgaatgaaattcagatatctcttggtaaattttataattattcctcccatcagctaaagttctcagtatgaagggttataactgatgtcatatacaataactacaagctgtatcatacaaaaattgagaattttctattatagaaagagttgctttaatctaaacctaaagtagcatcaataatttttcgtaagtggtccccttcctatgagtaagcccccaggaaaaataaattgcttttaagaaatgctgtaagtaagctgtttcatatataagttttgacaagatctggctacttaaattacaagatataaaatgagatttgtactttttctcaaatgtaaaaaaaaagatttacttctgaaataatggtctttataaaatatgcatttttgttcctttttcttatcatatctataaatttactaataaaagattctatcttgatttactaacatttgaaaagattgattatattggtattgcaagaagaggataccataaattaaaaatccatatattaaccatattcttttatttgcaatatgacaaatgattgtgtaaagttataatcaataaaagctatttgaaagtcataaaatggatattgccataactgctttcctagcaaggttaaaacactttaactatttttaatcaacttacagtgtagtagatcaagcatatctaaatattttattttaatcaagcaaatatatttctgctgttcctatgacagtatgaaagtttggttcaaaatatttccaaggtatttaacacagttcagtagaggtcctgtctcataaatcaatttcagattagataaaaggaaaaagcaaattcttgtttacttcagaatttttcaagccagttccaaagacagagttgttactctcatgtgaattttcagtagaaagctgaacaacgacgttgctctgacaatctttttaaataccatatgatggagacagaataacaaaaacaaagtaggtataagctgtacgaaattatttctcttggacataaaatatgtttggggaagaaatgcattgttccatatggactagggtagttacttctcaaagtgggagcaactcagactctgaaaaatggtttctcaaaggaggcattgtgtctgggtgaggccagttttctagtcaaaatcattttattaaatgccattggattgaatgcttccaggtttgctctctgaaatatgccctatcattcttaaaaaacacacttaggtagcaaaaagggcacactaaaaataacgtgggttaatgtttctatcctgcctgtgttttctaagtagcccctgcctgagctttcgacttttttaaatgaaccatcaaatagttggttgtctatcacaaataagccatctattttgttattcctgtaactttttgtagaatccagaaagtaacattcttgctgatatatcttatataacaccaagtccattttccaaatgaggattccaatgagtattcatcaccaacatctccccgaaaaatatttagaaaaaacagactcaatcctttatccaaagtcagtgagtaagaggcgggggccagggttggacaaaaatctctttggccaggaagccggtggtcaccctgatctacttctctaagctcccacccctgatgaatgttcaatatctgagtttcaccccactcattattgtaattctccgtaaaaccccagttacccacacggaattctcatctacatctagcccaatttgctactggatttcaatgttatttcatatgaaaacaatcactaacagaaagaacctggatctggtttcgaaaacataatttgaaaggaattcattctgaaggctgcaaaagcccagtgatggcccatcggtaccctgaatgggcttctcaggtgcctccactctcctccgtatgtctccatccatctcagaatacatgtctggctcttcctgctcataaacagaaacagagagttccgggatccaaaggcaagactgcgatttaagagacactttgtttttgtaggtgttcaaggatttggaatcaaagcagcagaattattaaaattaatccaattttcttgcatttattttgttagttcatacctctaaaagatatattttggaaggcacccttcaacccacccatttacaaatcaaagctttctttggaatccctgagaccaaacccaagctagacagtgacacactgccagctccagagccctgcccacctggaaggggtatggaatgcactatttgacttgagctcacatttaattacagtgtcaaaaatcaaacttaaattgctttaatcagctgccaacactatgagcctttctggcttgaatttctataaacaaagaataaattcaaatctgtcacaaagtggcagcaacttgttgaccactggactaggaatcgttatgcaaccatggctcactgtggaaaaagtcaacatcttcctatatgtgactcttttctgatcttttcggactattagtcaacagaatcatcataaagctaaattatctatctgcactgaaattactcagcctcagacatccaaaccagtagctgttcaccaatgaaacctgaataaagctgttgctgactttccctgcttcaatttagagtatttttggaaacatcattgcatgtttaaaatataataagcaaaaggacctttggtaattaaacattctgtaatttaaaactccaagagacaggagcagtgataagatattagattttctttactggggtgaaaaagacagaaagtggttaactgtttaaaaaaagaaagaaagaaagaaatccaaggatttttagagccagaaacagtaacagtgtcctttattctggaaatgtttaaaagcctgtaagcagagatcacccagttcatcctgagcattggtgagcaaataacttctgaaatgctcttgaaagagaattctccagccttctctgtttgaaatacttcctaaagcaaacacaaaagtgggcaaaacacaagagctcatgttaattccaaacaaagagaccaacagtcgcaaattgagagtccatcttagaagcgggtgctgcttccacatcaagcaactattggaaagagtaggggtagatgcagaattaagatcatttgtgactacagaaagagacaagaaaattaatttttaaaactaaaagagaaatttatttcagataatccaaggaaatgagcagagtcaacctaacaggattctcaagcccctccctactggtgtggtgtgaagatcacacgtggtgtagctgacacccctcacatcttccccgcgcccctcctgccacctctttttggcattcaccctctctcgggttctgtatccctgcccatgttctccatgaaaggccatgttaatgcccatgctctttcctgcctctaacagacgatgccttccacagtcactcaagctttaaccctcttctggattcggacctgtacatccaaaagcctgccagacatctcttccagatgctctcagagcacatgaccagaagcacgcgcaaagctctcctgagcctcagtgctttccctccaacacttcttccactctctcagttaccgagccaagacacagagttgcttgtgagtcatttctctacctcatcccccacccaaccttcctgcgagatcctgctcacgttacctcctaaatgctgttacgtgacttcaaccacgtcagctttttatgggggaggagaggcacctgcatatctgtgggagcaccaacctctagacatctcctgccaagttactgcaatgtgcagaaaagaggaagaaagcaagcccaagtcgcaaagtctttgccagtccttctaccaaccacaccttcggtggagatgtgggtctgtggaaatgcagagacggactgaaagccaaatgggccaatgagagctctgaacaaaacattaagcttgtttttctttaaggcaatacgattaacagtggtccattaagaatccgtttaaaaaaaataataataatactttttctgactattgttggggaagaataactcctttatggggagtatgaactcaaagacatgatattgtaaaggaggccttgaagaagagagggactaagaaatgtgatggcgtggtctgttacatgtgcaggtgctgtgtgtgagggaagcactgaggaccactggaggatgagggatgctctgtccttctcgggtatggctgaaggacagggattgcccatcaaggagtaaataatccatgagtggactaaattctttagaaacaggaactcaaatccagtagggattaggataaaaatgtaaactctaatttgcacctctccctctctcccctaagtagtccgtttctataattttatactaaatcaattaaatgtatctgctataatattaatcataattttgtctgaagtagtaacaactggaaactacctaaaagagtcagagcaggactgtaagactatattgtagtctacactatgtcacagcggactgcatcatgatagagaacgatactcatgatttaactgataaacacatatggcaatgaataaaactgtgagtaagatgtctttaattttagcaaaattatcttcattctaattttcaagtaaacttaaagatttatatataaatgcacataatttaattaaaatacatgcatatattaactagaaggctaatcccccaaaatgtccatagatgttatttctgagtgaggagggtcaggaaggttttaattttctttgtactaactctatttactaaaatgtccacctggattaacgttataataaaaatgttaccgtttaaaataaaatgaataaaatacaccggtatgaaggtattattagaacatacgaaagtacaaaatcaagcagcaaaaggaggaaattatattaagaactgaaaaaactatgttgagaattctgtctaagaaacgctgtagcaattaagaaaaatcccagttctgcaagtaatgggagaaagatgatgacttccagaactttcaccatctactaagatgttcaccaattcctaagaagggactgaatacgtctgcatcctcagatctgagagtaattttccacgacgcatactgagcaccataatgagtgaagtctctgagatgacctctctgacctctctaaaacaatcaggcactgcaaacatggcctatcccacactagcccttggtgaaattcaagggcataatattagactgaaacagtgagaagaagattcgacatggagtgcggcaagaatgtgttctagtccttgaaggccagcgctattccaagtgtggtctcagaccagcagcctcagctgcagctgggggcttggaaatggaaacgtatgtgctacgtcctggacctgtggaatcagaatctctgaggtggaccaggaatctgtgtttttaaaaccctgtggttggtaacttcctgctggctgaggacagagagaatgcttagtgaacgctgaggaatgacgggttaaataatccctgaatgattcctgagcggatcaatttctcagccagagttttgaccgcagctgatgatgaacagggctgtgaccaccaggaagggtctgaagaggaggcgttgattgcagttttctgcctctgatcctcaggcatggagccccaccccccaactctcttacacggaggccaaagaaaaagctggaattctccaggagagcaggacctgttaaacagcaaagggcaacccaaaattgtatgagtggccttgccctgagaagctttgaagccagaggttactgaacaactaccctggttaaaaccctaacgtgacaatgataacatgtgactgtatgtggctgtcttcaaaacagcaatgatttaggcacaactgtggatctcagattgttccgtgagtttggtctgataagattgtatgcgtttcccaggggtgccataacaaagtgccacaccctgggcggcttccgccaccgaaatgtattttctcacagctctgaggtcgaaagtccaagatcaaggtgtcagcagggctggttccttttgaggctgtgagggaggatctgttctaggctctctctcccccagcttctgggggctgctgcagtctttggtgttccttggcttatagaagcatcatcccaatctctgcttttgcgttcacatggccttctcctcatatacctgtctgtctccaaatttcctcttctcataaggacaccaagcactggattaggggcccaccctactacatctgcaataaccctatttccaaataaggtcacattttgagggaccagctaaatacaaaacattagccaggcatggtggtgggcacctgtagttccagctactcaggagaatcacttgaacctggattagaacttcacaattactgacacgattcaacccatattaggttgtttagtattatacattaggaagccatagcaaacttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcacccgccactacgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcccatagcaaacttttgtaaacataactatttattaaaatttggtataattaatatttaaatatcctttctggcaagatttagccagttttttaagcttcattgagagaaccacaatattagcattaataatagaatggtctattaattttttaaaaagatactatgtctgcatttccaatataaaattcacagcaatgattcaggtagaaattaaatgaggatgtcattgtcaaccttttaaattatattacaggagcagggagcacacgggccctgaggtagaaatgaataaggaatattctagaaccaccaagaagccagtgtggccacagcagagtgagccagtggtgctggaggcaggtgagatcttgaagggccttggcaacatgaacaggagcttggattttatccacattgccgagggaagtatgaggtggtgtttagcagggcataaatctcatctgatctgtactttgaggaaaacactctgacttctgtgtggagaacagtctataggaagccaagaggagaggcagggagatgagggaggggtgacttcagtctccaggagaatgagctagtgatgtgaattaaggtgctggtggtggaggaagtgaggtggagaactggacactgggatctattttgaagagggagcctacagaacttgttggtggatggctatgagggaaagaggattaaagaatgatgctaggcatttgggcttaaacaaacccctgagtaaatggttatcctattattaatactaagatgggtaatgctagggaaggagtagccttggggagcagtgatgagttattttcttagagagaagccacgttacctataggaggctcaacagagtatcaaattagaataaaatatctaatgttctgatttgtgtctttattttttccattaagatacacatggctggccaggcgcggtggctcatgcctgtaatcccagcactttgggaggctgaggcaggccgatcacctgaggtcaggagtttgagaccagcctggccaacgtggtgttaccccgtctgtattaaaaatacaaaatattagccaggcatggtggtgggcacctgtagttccagctactcaggaggctgaggtaggagaatcacttgaacccaggaggcagaagttgcagtgaaccgagatcacgccattgcactccagcctgggtgacaagagcgaaactccgtctcaaaaataaaaataaacaaaaaccatgggaaagaacaattgaggaaactggggacttgtcctggaacagaagacacgaggacttttggttttttagttttgtttttgtttttgagacagagtcttgctctgttgcctgagctggagtgcaatggtgcgaactcagctcactgcaacctccgcctcctgtattcaagtgattctcccacctttgcctcctgagtagctgagactataggcgcacaccaccatgcccagctaatttttgcatttttagtagagagagggtttcatcgtgttggccaggctgtcctcaaactcctgacctcaagtgatccacccgcctcggcctcccaaagtgccgggattgcagaagtgagccactgcgtccagcaagaatgaggtttgaagggaggcatgattgtgttctcttcaaatagttgaaaggttccatttgaaaaagggatttacttattcctatggttctagtaagttgcagagggtggatctaagaccattgggtgaactttacagagaggccagaaagccttctccaggggaagaaagtcaagaaaaggtctcaaaactgtctggcagaattctgcacaggagagtcctcaattcggtgtagaattggcaagtataataactgtaaatccctctcaatctaccatctacatcattaggcgacatcttcatttcctgaaaattccaacacatgaaggctcacttactatcaagatgagcaagtttgtgctacatagtgaatttgatttcaataggactcattttataccttttaagagtctttaaaacgttgaaaatgtaaagatctgcaagagcaactgatcttcaaagtcccgtcgagtcacaggattttgtaatgatgtctaaagaggaaaattcccatttcagaaaaggctcaatagtatttaatagttagctcaaaaggacgaataaagttctacatgggaagctgctgaactacagtcaggccaaaccttcatactcggagaagatgactgggcctgtagacacagatattgatgataaatcatcacaaaccacagctttccttaattggggtggtgggcagggagagcaggcttcaggttggccttcctccagcaagggcacacacacaaaggggacctgaacacgtggagcttatggtcaggaagcctgaagtgcctgacccagcacatctggtgactagtagtgtagattccccacagaaggaatgacaaggcgtcattattcaaagtgaccttccctccattggaataatcagaaacagctcacaaataaagtaatctgtaagatgcttcatcttctctaggtaacctctccccaacatgatgacatcacttcacatgaggcgacatggttttgtgaggacttttctttccttccaagtttggaatctggctgaaggctaaaatcaccatttacagtgtttgagccctccttcacactttgaagaagggtctgtgtaaatagccattcctacttctcagactcgccagaggcaaaacctgttttgctttggtagtacacgctcttccttaactggtaaaagactttaaaaaaaaataagatgccatttttaattgtttcataaatctggcttagatatattaaggaaattgctattttatatgtagaacagcggcaagcaaatctcaagagattaaaaatcatgttcttgtggttttcttttagaagctgcaaatttgaattcaatttaaaaaatcatggcacagggacaaaataagaatgaacaaagatgggaaaaatgtccgcagcattctgcagagtcaagcgctgctgtgagtgagtgtgcatgtttccaattacacatcagggcttggcgagctccaggagtcaaattcagacagaacccaagtgcagtgcgttacacagaacccaggccaggaaaagcttcacagagtctttctttcaactgaggcaattgtgtagacaatttggttcatttcaagaaaaaaataaaactgacagaagaaagaaaaatattattatattttgcctctcaaaacaaagtcaaattgtgttggtgtataaatcaagattcagtatttccttggctgcttccagaataatagtagatcacaaagagaataagaacaagaaagttcagttctcagccagacgatccaaggtaacaaagggtgagaccctcattccgttactcacaggagcaaacagacaaccaataataattgggcacatgggggtttcaacaagataaactgttatgtgagtccagggtgctaatttctggattcttttgagttgcaaggaaaatatataccgattccccacccccacccacccacataacaagacacaatagttaacagctggaagactgtggttagggggaaatgtgattgtaggcttccatttcaaatgatggaaaatcatttctgaagtcactacgaaagttacttcacaaaactaaaagaagccttgacaccttgtgttatcccatcatctaaagcaattctagtttggaaacacttgattcttggcaggggattctaaagaaggtgccgtatgtgaaaggctggtgtgtcagaaggagctttaaggaactggaatgagaacagccaaaagctaagatttctgattataatcacaggtctggatgtgttcaaggtaaaaagagatcatccccatcatttgcaatattttcaagagaatggggctttagtgacactgatcaaagtctgacatggattttcagctgccttccaactccacatacctgcaattcaatgatctctatggatagtagaagtaactgccaccctgatgttctcatcggtgatttatacgtgaagtggactcaaaagaaatacaacgaaatcccttaataaaaattatgtccattgacccaacaagcttcccagtgctgtatcagttctcaaccgattttagagacatttggtcaaaaatgatctacttgtaataagccatctgagggcactagctctttttcacctctgtgttccttgaagcaggaagtcagtaaaatcactattgaattaaaatgaagtaaagcactttgagatttcagatttctaaattaaggaacacacaacatacggtactttatttgcacaagaattattagaacccagggctaacacccaaatgaggtcacaggtaaatgaaaatctgtctcagttatttgaactcaggtcaacacacagacagagcaaagcaccagctgacctctgatgcacaacccagtgttcttaccatagaattccagaaggcatctcagtcattctcttatgtaaatacaaagacgacaactggtttaaaaattcatttatttttattttagcttctttgtgtcaaactcaaagaagcctcacataaatgatcaaagactttttggtggatcttccaaacgtacatgccgggaaggcctgcttgcactttttccttcaatcctctaaaatgaaggttttgaagatgcttgccaatggaacgttgtgccttacagctataatattttttaaaaggcattcagtttaaattaatatatttggccagacaactgtattaaaattcttgttgttttttctgttataatggtagcctgtggtatgactagtcttcttcaaaaatatgtacagttattgcttctctcttgcctggggtatatcatgtgtttttcatttgagtgtacattgcaatacctcattaaaaccaacacttaggctacacaaaagtcttcatatcatgccgcaaagggcgtaaactaacgtggaaagtttcagagcctcataactcattgcatatacctcttatactagctgctcaactgatatttagctctcctggatgatgtcacagtttttatcctcttaaaatagcctgccttcagaaaatatatagtttccttcatgcactaatcatggggagttacgatgtaaatagagccattttttttcttatacaaggaacaagtgctctcaccctcctcccttctctccctccccatacacagaagcacacttcacttcacttatactaaacacttcacttatacttacactgcaacaaagagttgcaaatacatgcaaataaagcctttataactcccctctctcctgctggacagctccttgactcaagtatttccgaagacagacactctgataagggtctgctctgagcttcattctcagcatacagtcctgggattatttacctaccaatattcacctctgcatgaaccagtaagtcattactgacaagaaaaaaacaatttgtgattttttttaatgtcacaatttttctttttaaggtttgggagagaaagttgttttgaatgtttcatcagtttctattgccaaatgaacacctgtttcagagtccctgaaagtcacacatcagaagcttctgacttcaacatatagtctgctttgaagaattattttaaaaaagcattgactgcttgaagataagcaagtgacactcaatagcttcattctttagtcttagaaaataatttttacacttcacacctattaggatggctactatgaaatataaaaaaaattaaaaataacaatggtggcaaaaatatgaagaaattagaacccttgtgcactgctggtgggaatatcaaatgatacagcctctatggaaaacagtatggtggctcctcaaaaaattaaaaatagaattaccatatgatccagcaattctacttctgggtatatattcaaaaaaatttaaagcaggatctcaaagagttctttgtacagccatgttcatggcagcattactcacaatagccaaaaggtcaaagcaacccaatcgtccatccacagatgaatgaataaacaaaatgtggcatacaataaaatgtcattcagtctttaaaaagaagaaaatttggacacattgtacaatatagatgaatctttttttaaattaaagtggtttttttaatcgttttattttaaagttccgagggacatgtgcaggatgtgcaggtgtgttacataggtaaacgtgtgccatggtggtttgctgcacctatcaacccatcacctaggtattaagcccagtatgtattagctattttccctaaggctctcccacccccaccatcccccaacatacaccatagatgaatcttaaggacattatgctgcgtgaaataaaccagtcacaaaaagacaaacagtgtatgattctacttatgtgaggtacctagagtagtccaagttcagaaagtagtaataatggttgccaaaaggtgggagcatgcagaacacggggagtgttgattgacatcaagtttctgttttgcaaggtaaagaagttccagagatttgctgcaccaacaatgtgaatatacttaacactactgaactgtaaagtggttgtgactacagattttatgttttatgtgtttgccacaaccaaaaataaagattaaattaaaaaataaaagattttatagcacctatcacttaccaaacccactgtacatcttacactcgtgaatattttatgattttcaaaacacctttatttttttcccttatttgttcattccttcatgtataacccacaatgtgttaggttatgtgctgggcagcctggaagacccaaagacgaattagggaagtaccctatatttaaagccttgcaaggacataaatatcagtaatataaagtaaaatatgttcactgctgaaaactgctatacttcctagatttttcaattcaattgcaatttctaatattttgccatgttgatcccacaaattcacttgtgtttaaaagttaacgtgcttgattatcatacagctgcttctttcataagaggaatacagataaaacgctatgggatttcagggggagaaagaacttcttattaaattcatattttcaaccaataagaaaacacaattttttttaatcaacactatcttcttggtgcttttttcacatctcatcctctttcctcctttaccctgcctaagcaaccatttctggacccaatcttgggttattacatctgacggcaagtgttatgtgggccatggaccatgagcaattagccccctctctactcctagggatggagtacatgtgatgatttccatcagactcagattaaatatcttgctggtaagttacccctaaaaatcgattaatggactctccaggtagacactgaggtaatctccaaccaaacctgacttatacttaggggctttggaagcccaccagagtcatcaagccatatctccacctaggctctatactggaaagctggtcagtagtaacacaaagaacaagccatttgggaaaacagcccacatgaaaagaactgtggtttcaagaagagtcattccatcccaggtttaaaatactcttctcctctttatctaccttgaggactcctatctatccttccataccagatccagcctcatcttctaagtgaagccctcctctgggacgtcagcgtctcctctgcatcccctagcattttatgcatcctctgttaaagcaactgtttgcacagctgtatccaccactaaacttagaggcaacagaccatggttttgaatgtgtagaacccaacacagagcccgagacctagtgggtattcagtgcatgttgaagggaagaatgaatgcatgagcaaacaagacaatggaagtctgtcatcagtatttacatttcaaaatgcaaagtgaaaattgtgcaaatctctaatcaagctgtactttaaaatgctaaattgatttggctaaaaatatttcaacactgaaatttctttttgcaagttaagtcttcgcataaccaaaacagaaaagaacgtatcaatgaactaaatagataaatttatggctgacaaaatctcaagatttagtgtgtgagaggaaagtaaaattcaatgtgtccttgaaagttctggggtctaagatatacaggccaatggaatagaatagagacttcagaaataaactattgcatatatggtctgataacttttgaaagtggttcaaagatcatttaatgagaaaaaaaggagtcttttcaacaactggtgttgggaaaactgggtatacatatgcaaaagaaaaaagttgggctcttaccttatactatatacaaaaattaactcaaaatagaacaaagaccaaaaaataaaagctaaaactctaaaattcttatgagaaaactctaaaatgcttagggaataacttcataacactggatttcacaagcctgtcttgaatatgacaccaaaagcacaggcaacataaataaaagagacaaatttgcctgcactaaaattaaacacttttgtgagtcaaacaagctatcaacaaagtcaaaagacatcctataaaataagagaaaatatctgaaaataatttatctaataagggattaatatccagaaaaaaaaatatatatatatatgtatataacctacaactcaacaacaacaacaaaaacaacccaatttaaaaatgggcaaaggacttgaacagaattttttccaaagataacactaatggccaataagtacatgaaattatgctcaacatcactaatcattgggaaaatgcaactcaaatccacaatgaaatacttcgtagccattagtatgactattaccaaaaaatcagaaaattacaagtgctggtggagatatggaaaagttgcaaatcttatgcactggtggtgggagagtaaaatgggaaagtcactataaaaaacagtctagtgattcaaaaattaaaaatagaattaacatatgattcaccaattccgcatgaagatagcaggaaattgaactgatatttgcacatccatgttcatagcagcattatttacaataaccaaaaggtggaggcaacccaagtgtccatccacagatgagtggataaacaaaatgtgatatacacatatcatgggatatcttcagccttagaaaaggagagaaattctgacatatgctataacacagatggacctttggaaagttaagagattgtcttatttatcttacgctaagagaaataagccatccacaaaaggacaaatgctgtacgattccacttgtgtgagttacctagggcagtcaaattcacagaaacagaaagtaaaatgatggtttccaggggctgagagaagggtagaatggaaagctattgtttaatgggttggagtgtcagtgtaagaaaatgaaaaaagttctggagatggatgatggtgagttttgcaccacaatgtgaatgtatttaataccactcaactgtacactaaaaaatggttaggatgataaattttatgtatattttactataacaaaaagtcataaaaatcaaacatggttcttctcattaaaaaaaaaagaagattcctgggtctagttggttctccctccttcttagttcttggatcaaggagatagaattgtgtccaaagtgaccaagtgacctacggagtaatgggcttccatctagccactccctgctttatgactgagctgcactgggagaggcattgtcaggggaaattccaggtttctagaattggtatctagccagaatttgtcccagggctaagtggctaaggcagtgaactagtctgtcagcttctctgttttaaatggagtcatgtaattccattacataccctttgctttcaactatatggccaaacatgactggccagcaggctgggggacagaagacatgtgggcttgtgcttgttacctggaattgaaaagagctcttggcatggttcttgttcaagctccatggttgactagcacatgaccaccaagagagctactgtacttctccgagactcattttctcttctgtaaaaaatgactgagtttctttcacagtgcataaatcttttcctccaggaacagagactgcccagggcctgtccaagacaactaggaaaccagagcagcagttaagccattcctgggcaggaataaatgagcagatgtcagctctcagaatctcagttttctcactcataaaatggaaaagaatactatttcttttatgtcattcaccatattgtgagctgaaggcactttaacgatgctgaggctgtaaactaatgcataatgtgatgtttatcattcttcacctatgttttagttactgagcatctcctgacaccagagaggacgcaacaaaaatcacaactcctagaactgcacagtctaaatggcaaccactagcccctgtgacaactgatcacttgaaaagtgagtagtccaaattaagatgtgctgtaggtgcaaaatatatgctggatttggaagatgttctatgaaaaaagtatctcattagtcatttttatattgattacatattaaaaagattccattttggctatgctggactcttcagatatatcctgggagattgtattaaaagaaaatacatgatggaaattagtgtaggtagttactagaaaatgtaaaattacatgattcacatcctatgttcactgttctagacatataaatataactttgagttatttttaagcatgagaagacagaaatcgacgaataaagtgaaaaagctaaagattaaagatacttacaaatcattgttgtattttttaagaggtcattttgagcatattccttaccattgaagcccctgcctgtctggctcctctgcccaccttgttttgctaatgggtcatgctcctatatgtgcatagacgaggagcggctctcagggactgaccgtaagcatagtcagcacagcacgtatacccatgctctgaccccaggttggcgtcttggagggtgaagcattttcccagtccttctttgactcatcacagaggtataaaacagcgtctccaacacgtgatttttttttttttttttttttgagacagagtcttgctctgtcgcccaggctggagtacagtggcacgatcttggctcactgcaacctccaactcccaggttcaatcaattctcctacctcagcctcccaagtagctgaaattacaggcacacaccaccacgcctggctaatttttgtattttagtagatacggggtttcacaatgttggccaggctggtctcaaactcccgacctcaagtgatccacccatcttggcctcccaaagtgctgggattacaggctgagccactgtgccagttaaaagaaaaaaaatattcaaacatatttggtttcttattgaggtgaagttcacataacatgaaactaacagttttaaagtgaacaattcagtagcatttaattaacaatgttgtccaaccaacacctctgtctagttccaaacatttttgtcaccccaaaaggaaaccacgtgctcagaaggcagtcactccacatcacccctcttcctagtcctatgctttgcacacaactgactcaccctgacagttataacctaaaagttaaataaaattattagtaaactgcaaacccctggcaagtgaattacttaatatctcttaaaatcctgacatcaaatgattcccctgtgaggccatgagatgataagaacatccacctccctctcttgctccagtggaatgaaaccccctcctcaaggagggttacactcaggcataggcccgatcactcatcatatattgacagatgtgcaggcctgagaccccgccttctggagctttctaatgctccttgtttctcaatccaatccttgctaggaattaggctcttctgctgaatgtaaaatttttccatctgcctccataaagtatgtgccacctgtcagctgactggtcaaccccaagctcaaagtatatggacattttgggggtgacaatggtgggcatacatctttagcaaagattaagaaggtaccagaggaggaccagcacaacccagcaatgcagcagaatccatcaggaaagctttggctctgggtggagctccttgctttagctctgcctttgagcgcttgggtggctggggaggcactggggtggaagggaaggaagcaggaattcgtgtgctgcaaatttcactacacttgaccacaacttggagtggaaagggcactgtggtacgtctatctggccttcctttacaagccttaaaatgctgtggaatccatctggatggaagacgccatccaattataaatccttaggatactttttattgccctttaagagttccgatgcttgctcttccatgcccatatgtttctgcttaagaggcttcattcaaatcaaattggaagagaagtccagattacccaactacaattacctgagcaaaaatcccctcaattatcttggtaatccagataaattcggagtacaaaggtgagttgcctggatagcactggctaagaactgctttgtctcccatttcaccttgcattattataatctacttgattacacttcatttataacaatagggagggcttgttttatgccacacattgccacttgctcaagtgtaaaataaaccttaaatgactgatgtactgctaaatttatctcaaaaaacaatcataacaggaatcttaaggcaataaagtcaaacaaatagaattttacagaatttaaaaattattttgtgagtgatttatgctaaaatacctcaaatttatttcaaaaacagtcttacttaaaactgacttaaaatatatgtaggataaataatttgtagtgaatttaacgaaacttcagcaattcaaatgaatgcacattattcttcttaaaaacagatatcctgaaaatatccatcaggataaatagctaatgcatgtgtggcctaatatctaggtgatgggttgataggtgcagggaaccaccatggcacatgtttacctgtgtaacaaacctgcacatccggcacatatatcctggaacgtaaaattaaattaaatttttaaaaagcagatatttggaaagtaccaatagcttcaaagtaaaaatactctacactgtttttgtttgtttgtttattttcgtttttgtttttcttttttgagatggagtctcgctctgttgcccaggctggagtgcagtggcgtgttctcagcttaccacaacctctgcctcctgggttcaagtgattctcctgacttggccgtgccaccatgcccagctaatttttttacatttttggtagagatgatggggtttcactgtgttggccaggctggtctcgaactcctgacctcgtgatccacccgcctcagcctcccaaagtgctgggattacaggcgtgagtcaccgcgcctggcctatgcactgttaattttatcacgacagttataaatccatcaagatgtcctgtgatttttcaacacaaattactcaaattatgaacttctctgtgtgtattttccactggcttgtttatgaatcctgctgatatgtctgctacaatttctccaaaggctaaaagatgtttacaggacaaatgacatcatgaccatgtcaggcttaaatgtgtttatatcagttgggtttagagggtcttcaaaacatggctttaaaatctcagttattatggagcttaatgtgttcctgatgtttctggagtaatgtatttctaaaaatagagaaatagattggttaaaagaaaatgaattgttggtctaatctgtcttatgcatggctaacgaaatgcattttcactctcttccgtgataatacgacacttaaaactgtgaggaccaatggggtgataagagacaaaataaacagtaaatagatactccatgtgagttactactctgtaatagatagaaaagatattttatagaaaagggaaaatacccacagacatataagcaatgtcctgtggttgctatcaaatttactgttagctgtttaaaactgccttaaaggttttttaaatgtgtcttttctaccatagattctttagacgacagccatcaagcagcaaatacctcgcaggaggccattgtgtttctatttgaacttctatggatgtcaagctctgttcttcaaaatttagccctacagatgggtggcccaccggagagaattaatctcactatgcagccaacactaccctttctggatctttccccagtagtgtggattctgctctagtccagaattatgcagaataagtatacttcatcttagacaccataattcttcaaatatctaaaatgtatattatgctctccaaatcctggtcatctccaggttaagtatctctcaaaaacagtccatcagataatatgattttaaatctttatccccttggtcatatacccacaatctcattctatttaccaatatccctactgatgcataaactacatatgtatatgtgtgtttttttttaaaaaaaaagcaattccactgtaattttagcagaggttatttccacatagagctatgtatatgtgtatatacacatatctttatattatatagttttctgtgctttcccagttatctacaatgggcatatatgacttttatagccaggtaattcaatattcattcattcagtgaacatcattgagcatccactatgggctgggaagtgaggatggagccacaaacaagcaaaataaaaacccctgctcttgtggagttcccttctcattggaagagacgtacagtaaagaaaaaaataaaagagtaaagttaatagcctgtgagaaggggatataaaagtgggaaggaagacagggtgatgtgtgagaaacactttttttttttttttttcagatgaagtctcactctgttgcccaggctggagggcagtggctcgatctcagctcactgcaacctccacctcctggtttcaagcagttctcctgcctcagcctcccaagtagctgggacttcaggcatgcaccaccatgcctagctaatttttatatttttagtagagacaggatttcaccatgttggccaggctggtcgtctcaaacttctgacctcaagtgatctgcctgccttgacctccgaaagtgctgggactacagcaatgagctgccaagcccggcctggggaacactattgaatagtgtggtcagggaaggctttactgtgaaggtgatgaagacccaaagaaagtgaggaactaagtcataaatgatgggtagaacattccggattgcgggagcagcaagtgcaaaggccctggggtgaggaataccaagaatgtttgtgtgggcagagcagaaagaaccaagggtaaagcattaggagatgaggctgaagaagtaaccgggatcaggtggttagggccctcaggccctggaggaaggctggcagcgctggagccacatggactgacaatgtctagcagtcatcccggctccctgtgaagaacagaccctcgcttgcagagaagcgaggacaattaggaaagcagagtcatgatccacgcacaggatcacggtgacttggaccagaaagagagcagtggagctggggagtgactcttttcagtatttctcaggtggtaccagtgggatctgcagagaatacatagttaaaggaaatgtctggaactaaacatgactcttcaaacgtgatcctactgtggcagaagagaggcgactttacatttcctttcccaggatatcttattctaatgaacacagaaaccgtaaaatcaagccaaccaacatgatgaaaatgattatataaggtacacagcccaggctggatttgaactgatgagggaaaaaaaatctctagtgaaaattcctctctctaaccacagccttctctccttccatctctgcctcacccttgctctttctgaagccttcctggatgctcatgaagctctctccttctttgactcatcctattttcccaggacctttatcaactcagggctcttctcccctccccacagtcagctcactgtgctctgactagttccctgaaattgctcatcctcttactaaccaggaagcttctacccgctcttggtcttctttctccaccccagtgccaaagaactaagcactgatggagaaaaagcatgcggctaatactgtctgtctctaccacaaatctcataatttttaaaatccatttggaatttacattcactccttaacttcttttcattcactcctaattcacttcctatataattctctacacagctgctgaaaaccttcctttctgctgcctcttaccccaaaactactctcacattactcacaaaggttgaccttgttttctatatacttttttagagtaacgaagccataaaatgtaagttctttcaacctggacctcccactcttgggatttctcaatagcttcacctgtattctcccccttcactcttgactcagaggtaaacgctcccttgctcccaaatcctttagcaacgtagggttgataattgctcctttccaaatttaatccctgcatctgcgcccctgagacagacactgccatgatttcccagcttgctgtcttctccctcctgcatctcctccctttctctgtgacggatattttccctgtgcaagagaaatttcttctgccctaaaataaataatccaaaacatctcttgactccacttaagctaacattcaatatctcactttcccttgtattaacaaaagttaattgagtcagtacggtgctacaattctcagacacaacgataaacatgatagagaccatcaacatgccttggcattttgcctgctttctcttcaattacttgcaacttggcttctactgagctccactgaaaaagctttcatgacatgaccacatccaatcccaaagaaactgtccccttgcccagtggtcttcaaaaccctccaactccacagtgtctcattaactccaactcatttcctactaaacatctcttctcagctcttcaaagtcaaagattgcgaaccaaatctacagacttctcctctcttctcctttgggtccaactccatccttctccatgaaacttcttattcctagaaatggtgtctgcaccttttaggcttccaggcttgagcctagagtcatctttaactctttccatacccagactcccaagacccagtcagctgtttaggtgtctcctctgtatgcagcacttactgtcattgccctggtccatctcccagagcccacatcttgtcccactgtctgcaaagcctttcctatatgctggatataagtgcaaactccccctaaaatcccattgaagtttttacttttttctatcttctttttttacttctttttatcttcctctactcacacagaagtgctccaattatgaggaccttattttattccctttactgtcaaacacaaagccaacatgccatacgaaaagatagtactgtgcttccttcagtgccactctagcacgcccactccagcacacccttcttgtgcgggtgtatgctcatgtgatactatcacaggcaacacttactatgcaatacgttttccacaatcacaatatttccacaatattgtgatatgagctcattcttcaggccttgacacaagcgcccacaaacctaagagaatgcattttcatttttatgatacacagttttcgactgctccactctggctgccaaggcattcctcctccaaatcacgatgtctatatcaaaagaagaacaatgagggagagctggaggtagcgctaagaaacaacctggtccagctcccaggtctcatagagaacactcagaacacgcttgttagaggtatctgctcctggcctcagcttctcagaagcaattacacatcttctgggtaaacgtggagtgtgcagcacagaataccaaagctgagcttcccattgtacctggttgttgatctcctcgttgacctccctcagctgaatatttcttaagaacagtgttcaattaatccaactatccctggtggctggcaggatgaatcagttatgacttatttcatgtttgtgggtgggtgtatgaagtggtcctcaaaggagatttttgctctctgcagacagtctgcctgtctgtaggtcacttcctgccatttcctttgagtgggaatatgagccagggtgttggaagaaggaagagtccaaaagatgtctcagggaatgtcccatagccattggcctggtctgccctagataacttctgagccaggtcaccctaaagtgctacatgaaaagtcatggattttttttctaacttgttgatctcaaatgtcgtgatttggcatgaatatctagcttcccatgttgcagctatggatttattcttgccaaaatattggggattgggctggagagggaagaaggtacgaagatgcattctgtgttgctcaacaagatctgcatggcctcaaccaatgcgtgtttgaccatatggatatttacaaaccccaccatcaactcaccaaaatgaagagtgtcttagacttattctcacaagacaagagggaacgctgcctctaaggagtctctctgggacacctgggagagatttatttaatggtaaagcaaggaaaggaaaagatgaacagtgacctgcaaatcattaaagagggcgactcgatcataggcaagggcttttattagtgctaaaattccacttcaaagtttgctgattcatggatgctttttgttttgctgtttatgttgtagaaactgatttgattttcatagacaaaataactaggcatttataaccacatataggtatgaaagaaagataaaatgatgcccttagcccagtcagaaatactcttaaccatcaaaatagttccctgaatctaataggccaacaatattccaacaccagaacctttgctaccatagccagaatttttaagactgcaccactgttaagtagaggcaatttttaatacttagggtctaaccacaaggcataaaatgcaaaaaaaattacataatcctgtactttttaataattaaatgaaaatacatagactctaagcaggaaaatatctgagatccttaaaacggtataatcataattgttctacattggtaatatgtgtgatgatatttttctccaaaaaaaattctctaccatttcattctctttaatttcttctagcccgtaaggtctagcaaagaggaatacctgaaaagatgcaaattgtacccctgtgctgttcaatgacagcaaaaattgcagctccccaaccccacctcttatgtcccctgagcaatctgtgatcacttgagggtgaggacagtatattgccccaataaactggctttccaccaagtaccaccaagaaatcaaaacagcttttattttattgtgtcatcatatataagttaatagttcataattagttcaaaatttaaaattatgttctaaaaataaagctttctaagtcaatgtaggcaacgattccaagatccttatagttttcctctcttaaacagagaccattatcatatgatttttttttttttttgagacggaagctcactctgttgcccaggctggagtgcagtggtgcgatctctgctcactgcaagctctgcctcctgggttcacgccattctcctgcctcagcctcccaagtagctgggactagaggcacccgccaccacgcccggctaatttttttttttttttttttttttgcatttttagtaaagaccacgtttgaccgtgttagccaggatggtctcgatctcctgacctcatgatctgccagccttaacctcccaaagtgctgagattacaggcgtgagccaccgtgcctggccagtcatatgatttctaaagagaaactgaacagttatttgtagaaactctgcaaagcatgactttgggacgggcacagtggctcacgcctgtaatcccagcactttgggaggctgaggcgggcagatcacgaggtcgggagatcgagaccatcctggctaacatggtgaaaccccgcctctactaaaaaaatacaaaaaaattagccaggcatggtggtgggcgcctgtagtcccagctacttgggaggctgaggcaggagaatggcgtgaacccaggaggcggagcttgcagtgagccaagatcgcaccaccgcactccagcctgggcaacagagcaagactctgtctcaaaaaacaaaacaaaacaacaaaacaaaacaaaacaaaaaagccatgcccaagcccacccctgaccagtgaaatctccgggattggggcacaggtataatgtttttataaacatcttcctagatgtttcctgcatccagggtgataaatcatcatactaaaggcatcatctgaaggctcctagagtatagagaagttcagaataaggaccccaaactattgcacatcctgacactaactagctgtagctgtgcaccctggacagggagagatctaaacagctagttatcttacttcaccgaaatctacaactaaagatgtctatccacgtgttatagctttggcttccctaatctagatgttcaatctacttttctgcaatttggcaaagtaaaacacacatatacagtaatgcacaatgtcctgattgttggggtttattatttgttttgcatttacgcttcttaggtatgtaacatgccaaagtcatgggagctgagtcttttgaaacagaggcttctttgggtgcaaatattaattttctatgaaaaaaagagaaagtacaaagaaaagaaaaaacagcagtaatacagaaatgaatatcttccttgtctaggacacagtgttttttttaacctagatttctttgaacacagactgacacaaaaattaaatactattgctccattggagaggtgcaaacctggggcggtgagagtgaggggaagcgagtgagattgtcactacactagcttctggggacatggagacagccagtcactgagcccctgccttcccttggccatgcagatgcctctgataggttacacggaaaaattctacctcacagcagcccatggggtggaggaaaaataggaacttagttgcctacattcttcctgcatccccttcctcattggtcagagtcaccctgcatgtctgggttgtcacctgctcccaaggtgaccactccaaaagtcaggttctacgcccggtggtggggtgcttcatccaagtacagaaatgccaagaggatccggaaaccttttgacctggttgctgagtcacaggaaagaagggccagccctcctgggacaggtaacaggctggccctgagctgtggaagccctcacacccagaaggagtcaatctgctggggtggccactgagaccaagcaggagctgagggtcctggagtaatagatggaggcccatgagatgtgttcagacacatagtgtgtttgtcaactgcaatgtgtgtgtgcccccaaaattcatgggtttaaatccttacccccaaggtagcagtatgaggaggaggggcctttggaaggtgactaggtcataaggatggaggtctcatgaattgcattagtacctttacaaaagggaccccagggagattccctcacccttttgtcacagtgtgaagacccagcaagaagatggacatctatgaatcaggaagagagccctcaccagaacccaaccctgctacactctgatctcagacttccagcctttagaactgtgagaaataagtttctgttgtttatatgccactcaatgtatagcactttgttacagcagcccaagctaagacagcctattatgtatgagcaggtggctttgagataattgagaaaacagagactataactacaaccagccagagatgggatcattgcaaatgggactcgggttcacacaaggtttgtgacacacacacaaaaaaacataaggcagataaatcagcaagggtagcagtcaggaattgacagacgattaatggattgaggaaacagaatagataatttaaaagcaaacctttgtacacaaaagaattcaggaggtgataaaagtaacattttcatatcagttggaaagtaagttattcaatagcaacagaacaatcatttattgaggaaaaataactatttctttcctggttcaatcttggggtgttgtatgtttccataaatttatccctttttttctgggttttctaatttttgtgcacagaaatgttttttaatagtctctgaggttttttttttatttctgtgggttcagtggtaatgtcccctttgtcatttctgattatgcttatttggatcttctctcttttttctttatcagtctagctagttgtctatcaatcttatttattctttcaaaaaaccaacttttatttttgttggtcttttgcatggtttttttgtatctcaatttcattcagttcagccccgattttggttatttcttttcttctgctagcagtaagtttggtttgctcttgttttttctagttcctccaggtgtgacattaggctgttaatttaagatctttccaactttttgatatcagtgtttagtgctataaactttcctgttaacattgctttaactgtatcccagagattctggtatggtgtatctttgttttcatttgtttcaaataatttattgatttctgtcttagtttcattgtttacccaaaagtcattcaggagcaggttgttcaatttccatgattttgagagatattcttagcattgattttatttttaccgtgctgtggtctgaaagtacggctagtatgatttcagggttttttttcatttgttgcaaattgttttatagccaagtgcgtagtcaattttgaagtatgtgccacgtgtaggtgaaaagaatgcatattgtgtcgttgttgggtgcagtgttctggagatgtctgttaggtccatttggtcaagtgtcaagtttaggtctcaaatatgttaagttagttttctgccttgatgatctatctaatactgtcagtgagatgttgaaatctcccactattattgtatggttatctaagtctctcactaggtccctaaaacttgatttatgaatctgagtgctccagcattgggtgcatacatatctagaacagttaagtcttcttgttgaattggaccctttatcattatataatgcccttctttgtcttttttgatcattgttggtttaaagtctgaaattgaaacgctgaacagaccaataacgaattacaaaattaaatcagtaatataaagactaccaaccagaaaaagccctagaccagagagattcacaaccaaattctaccagatgtataacaaagagctactaccaatcctactgaaactattacaaaagatttaggaggaaagactcctccttaacctcattttatgaggccagtatcattttgatacagaaacctggcagagacacaataagaaaagaaacttcaggccaatattcatgatgaacagggatttggaaatcctcaacaaaataccagtaaaccaaatccagtaccacatcaaaaagctaatccaccatgattaactacacattattcctgggatgcaaggttggctcaacatatgcagatcaataaatgtgattcatcccataaacagaactaaacacaaaaaccacatgatcatctcaatagctgcagaaaagacttccaataaaattcaacatcctttcatgtttaaaacactgacaaactaggcattgaaagaacatacctcaaaatactaacagccatctatgacaaacccacagcaacactgtactgaacaggaaaagctggaagcattccccatgagaattgaaacaagctaaggatgcccactctcaccactcttagtcaatatagtactggaagtcctagccagagcaatcaagcaagagaaaaaaaaaaaaaagaaacaaaatacatccaaatgggaagagaggaagtcaaactatctctcttcacagaggacgtgatttatgtctggaaaacctcattgtatctgtctaaaaactcctggatctgaaaaacaatttcacaacgttttaggatacaaaatcaatgtacaaaaatcagtagcatttctaaacatcaacaatgtccaagctgagagccatatcaagaatgcaattccattcaaaatagcaacaaaaaaaatacaatacttaagggtacagataactggggagtgaaaatctctatgacaagtattacaaaacaaagatcaaagaaatcagagatgacacaaagaaatggaaaaacattccatgcccatggataggaagaatcaatattgttaaaatggccatacttcccaaagcaacttatagattcaatgctatttctatcatattactaattacattttcacagaattagaaaaaactatttggaaattcatatggaaccacagaagagcctaaatagccaaagcaattctaggaaaccaaaaagctgaagtatcacactacctagcttcaaactatgccataaggccacagtaaccaagacagcatagaactagtacaaaaacagacacataaaccaatggactagattagagaacccagaagtaatgtcacacatctatagtcatctaatcttcaacaaagtagacaaaacaagcaatgtggaaaggattccctattcaataaatagtgcttggataactagctagccatatgcagaagattgaaactagactctttcattttaccatatacaaaaatcaactcaagatggattaaagacttaaatgtaaatcatacaactataaaaacctagaagaaaacctagaacataccattctggacataggccctggcaaagatttcatgacagactccaaaagcaatggcaacaaaaacagaaattgacaaatgggacctaattaaactaaagagcttctgcacagcaaaagaaactatcaatagagtatacagacaatgtacagaataggagaaaatatttgcaaattatgcatccaacaaaggtctaatatgcagaatctataaaaaaaaacttaagcaaattaacaagcaaaaaacaacttctttaaaaaaaatgggccaaaaaaacatgaaaagacacttctcaaaagaagacatgtgtgaccaacaagcatatgaaaaaacgctcaacatcactaatcactagagaaaagcaaaccaaaaccaccatgagatatcatgacacaccagtcagaacggcaattttaaaagtcaaaaaataacacatgttggtgaggctgcagagaaaaaggaacagttatatgctgcgtgtgtgaatgtaaattagttcagacactgtggaaagcagtttggagatttcccaaagaacttaaaatagaactaccattcaacccaataatcccatcactgggtatataaaggaatataaattgttctactgtaaagacacctgcattattcacagcattattcacaatagcaaagacatagaaccaatctagaagtccatcagtggtggactggataaagaaaaaaatgtggtacacaaacattacagaatactacacagccataaaatagaatgaaatcatgtcctttgcagtaacatgaatggagctggaggccattatcctaagggagttaacacaggagcggaaaaccaaataccacatgttttcacttataagtgggagctaaacactgagcacacatggacacaaagaatggaatgatagacaccaggggctgcttgagggtggagggtagacgaagggtgaagattgaaaaactaccaattgggcactatgcttattacatggtttatgaaataatctgcacaccaaactctcatggcatgcaatttacccacgtaacaaacgtacacgtgtacccccgaacctaaaataaaagttagaaaggaaaaaaaaaaaactaaatccctatctcacattatacatctaaaaaatccaaatagattagatttaattaaaaattaaaccataaaacacagaaagaaaatacagatgaatagttatataatttaggatgagaacagcctctgtcaggatgaactaaagaattcacaaaaaaaaatgttaacaaattaaatgacatgttaaaaatctggccaggggtagtggttcacacctgtaatcccagcactttgggatgctgaggcgggcggattacctgaggtcaggagtttgagaccagcctggccaacatagtgaaacctcgtctctactgaaagtacaaaaattatccaggcatggtggcacacgcctgtaatcccagctactcaggaggctgaggcaggagaattgcttgagcccgggagacggaggctgcagtgagctgagatcatgccactgcactccagcctggctgacagagggagactctgtctcaaaaaaaaaaaattaagaaactatatattgaaagactataaaaaatagttttggtttttttctcagtaaaaaaataatatatccattgtcaaaaattttctattttcaatattattatttaatagaaaaatttcaacaatttctggagaaaatatatgaaacacatttgacagagttttaacatccttaacataaaggatgtaacttatatgttacatccttaacataattttctttgttcagttaacaagtttttattgagtatctatattgaaatatgcactatgtctgacactggcaacacatttgaggaaataaagaagaaaaattcaagtccacatggaaaaatggactaaggacatgaaaaagtataaatcatcagtacacttctaataaagttaataatcaaagaaatgcaaataaatgtgacctatcaaggtcttgctatttgtactgtcaaattataaaaatacaataacaaatattggcagatattggggaaacaagtaatgtcatatactggtatgtgcttaaactggtaaaagtcttcagaaaggaaattggaaatatatgtaaaaattttggacagttgcatattctttgttctagaaattctacttatatgattagaacctaaggaagttatcatagatttaatcaaagatagttacaggatattcaacatagccctgtatataacagccaagaatctgaagccaacaaaaaatatttagcttaaaatgtatagaatatacataggatgaaattgcataggtcactaaacagtttctagggacatggaaaaaaaaatgccatattgcagaaatgcaatattttgggatgataaaagggcagtttcaaaaaattgaaaaaatagcagttactatgacctcttttggcaaaaataattatatgtaatattgttcatggaaaaatagactggaaatataacgattaaaatgttaattgtatctgggttggtgagattacatataattattatatataatctttacttttttagattgttgttcacagtgacatcaagatttgtcatgggagaaaaaatgaagaagattattattttgtagtcacccaaggagagaagaagtcacatctctggagataggaggagatagggcatatgagccaatcacatttctgcagccttttgtggatacaaaaggggtgggccaagcctttccaatatcccttttcctccttggtacccagacagactatatttaccagcctcctttgcagccaggtgtggtcatgtgactcattcctggtcaatgaaaggtagatggaagcctggcctaggaaacaggtctacatgcaatcttccattcttctcccacccactggctgaaaagaaaggcttctgaggacacagagtggggggaaggctaggtagaggctggatgggaagaaagcagggttctcttgctcctctcatcagagagctactgaggagacccaccgcacccagacccccatactggactgttacaggagtgagaaataaactttgtttagaccactgaaatttgagagttagagctattagcctaccctgattaacgctggggtagcccctcacatctgcccagcaccctcagcagagcctaacccaatcatccaaggttacccaatagagaactcaggcttccactagagtagccgtcacatagagttactgggtcttccaggttctgccacctccaccgtgttttgtgggactctccactgaactcacaaagcacatgtattcagctactccaaagctatgtgtactcaggaagagaaagttctaaatgtttctgtgaccttgtgccactgatatcatgggttctatccttcagagtgctaagaaaagtgttaaatctccagaatagctttggaaaagtggagaaatttgagactttctctatttttagttgctaatatgcattcctgaaaagtttatttaaagccacaaggaaatatttccatattgaatttcaatattgcaatatactattttagaataaaatggaaagatccaggacatagagcagctgagaagctacacagttggcccctgggcttcactcagacagtgcttctctaggctgcaagtcataagtctttgtgtcacccacttttagaagacatcccccggacttctgggaccaacctgaggtttgtaggaatctctgaggatcaatgatcaaacatatattagcttgaaaaaaaactaatatatgtgtatgtttttttaaaaggttaagtttttaacaatttagacgtcttggcattatactctgagaacgttaaccaatgagaataagagtgacaatttagatgtaaaacctcttaaaggtaaagataaaatcctaaccacatggggaaaaccatgtgttctgtggatgatttccctggatttctcaaaagactcttagaatgttctgggtatgactttgggggcatctgttctatgaagatgggcaccccagcatcacctgcatattaacccttcttcttgctcctaaagatgcagaattagctgagattaggaagatgtacaaagtgttctccctgcacttcaactaatgaacaaaactttttaaaaattacttatgatttggaactattttatcattttatatatcctatggcaactggcattttatatttaattttatcatcttttgctttttttctttgatctaaatcaggatgctaagttttgggggggggtcctacagttttggcagagacctcattctaaaaaagaggtaccagactattaaggcagaatctgctgagggtggccccaaacctggtctggtgaacctcactcaactcatcattgatttcaagggcacagaagaggcaaggagatgacagcaggagaaatggacatgtaccatggagaaaggggaccaaccacaccttctgtccaaactgagatttcccagcctgaaacaggtcaacactggggttagcaagaaactttaaactgaataggagattaaagtaataagaagatgagtactattattggtacaaattatattggtaatagttttaagtttcattctttaagacagggtgaatcacagtcccttctctcaaggtccttgtcagcattctacttttccaaggacattcaaaaatttctcatccaaagtcaaacattagtgtgtgtgcctcaaacaagaaatagttttccatcagtctccaaatctttgaatagtaaatggcaaaagtatggaaatgcaagatggagtggggcttaatgttgccacaacattcctacaatactgggatagtcttccttgggaattactttctttcctatcacgtatcaataaggaaagccaaatgtagaaataaagaaatctccccgatttacttaacacacggaggtgacagttacagcgcaaattgagggaagagtaaatgatttccacaaatgaaccaaaaacacttaaaagccacatttaagagaaatggagtcataaaggcaatatttgtgagcagataaaaaatcagcacagaaaaaggtgagaaatacacaatgtctttcatcaaggtgcaaggaaatgtaaaataacattaaaagtaccaactacataatttgaatataaagagaacaatagcaagaaaggagaggggaagtgatggcgatatggagacacagtctcttttgcatgcacagggcagaaccggtgcctcaggctggagggtgtctgtgagtaccccacaatgaaagcaaaagagcacccagcattgaagccacagaccttgctccatgaatcctagctgatgggctggcacagagagatcaggagcagaacaaggaaatccataggaggatcctcccaaagtacttttttttctggtccaaaaatccttaaatctgtcagaagcaggaggttggagtgggagaattgcagagcctggaacacacctgcctgctgatgacccattctgagggggttctttccacttggcagcaatggacttggtaaaaaaaataatagatccttctccatggatcccatttccctttttttttttttttttttttttgagatggagccccaggcagaattaaagaccaactctgggacccaaatttttagaggacaaaggttgatataatggccagcacgatttagtcatttagatttcaggtctaactaactgatgacagactttaacaaaatcactgaaagaaatttaacgtcaaccttaaataacagtagaggcaggtaatataacaaatagagtcaaaatggtttatctaaaggtctaagcccaagaaacatccaacaataaaattaatctaaaacaaattttttaataatcatttttttttcttgagacagagtttcgctcttgttgcccaggctggagtgccatggcacggtcttggctcactgcaccccctgcctcccgggttcaagtgatttcctgcctcagtctcccaagtagctgggattacaggcatgcgccaccacgcccagctaatttttttgtatttttagtagagatggggtttcaccatgttggtcaggctggcctcgaactcctgacctcaggtgatccacccaccttggtctcccaaagtgctgggattataggcgtgagacaccacacccggcctcatcttttctttaacattacaatttcccatcatggtggcacttgacagtagtgggactgtccaacagcaaatgaccccatctaagcactcaggacagaagccattttaggtcatgaaaattatacagattttgtgagtgaagggcatttagttctgagcagaaagtagtcttgcaaaagggaaatttgcaacaacaacaaaaaaggacaaggagggtgacaatgtcaagcaaatgataaccctgctggagcttcagaaggaaccagctacatccctttcctgcttctacagatgctatggcagccccagaggtgtcccactaggatctcccttcaagaaagaatctagcatgcatctgaacaacctccagctgttcacacctcaggccctgcctcatcccagacagccctgagccaatcactgacacagcagggtactagagcctggtcatttctgcccaacccggggcccctccaaaggcaagctctgctccagacctccccgttgggttggtcaaactatcaaatctgtacctggtctgaggctctccctgcccagtcttgcttcatcctcattttatccttcacaggcacagcccccttccccctccaataaaacactaacattcctaattccgtctcaacatctgcttcccagggaacctaactaacacaatactcctaaaaccaataccagcaaaaagtgactttccaagcccctacatgaagactcattttctggaaaataaaatttaatataattccaattacccatgacgctatttagccatttcaaaggaaatgagaaagcttcccaaattgtggtcctcatggagtgaactgatcatcaaatgttgctgtttacatgagggcacacaataattagggttgtatgtaacatgctactttcagattttcaggtaagtctaaatgcttttaattgatgcaagaataataagtccttcagttgatttatgtcatgcattaatatcaatcaaaaggttttctaacacatactttttaatactataaaatgtggggttttttttaatgtcttttttttcttattcagagccacatttcttcacatggtatgttttacctaacctaagggttatgttgttcgtttgtttttaatttcaggtttgaggaatcaagtaacaggtctttctaaatccttttattggatatatgttagttttccattatcataaaagactgaggaacaggaacagcagcatattgtttaaatgattcacaggtaaaaatatcttctccctcttggtctgttttctttcctgatgtctttgctcattgccaacattgtctattttatatataattcttgcaggacattgtgccctgaaggtgaaattggacaggtaaggagatgacccaacaccccttgtcacacctgcaggctctaggtcacttttgtaacacacaatgaaatgggtaaattctacacaatcctttttttttttttttcaaacaataacagaaagtaaatatttgaactgggggctttttcaaacaacacaagtcagaaaaaattgacttgtttttgactgttactttaggcatatatttttgattaatgacaattaaatgtaaatataaagatattttaaacttgaggttttaaaacaaagaatgcaagaatcacctggttaaagttagatattttgtcagtctcaaagtcagttggctggataataccatatcataaaattttataagactaatttgaaggtccatatgaattggtattattgttcgtttttcaatattgatcttagcagtgtatttacagcatacagcagagttaatgtttaatacaaacaaacaagactttccagaaaatctacaaagaatcactaactaatagccatgcttcagttaaatttgtttactttttaaagtacattctcagaagtaacatgtactctcaattaagtaaaacacaaccagaattttggaatttgatctttaaaataataaaaaaactttctctgctatttacagccttggttaaaatcccaacatctggataccagaatctgagcagcaaaatccacggagacacatgtgcaattttatgcctgcaagctcactattatttagaacgaaaccaacgtagtgcatctacccttgtttcttgctacacagaatgtatccagagtacaaactaatgtagattattataaaactcagtgtgtagatattatatatatatacacatgcatacatacacgcacatatataactaaaacaaaatcttcaaaaataatactttttctttctgtatgtgatgtgccctgatagtttccactttactccatcccatttccttttgttaatactggccttgactcacttagacaaatgggtcatgacctgtagtttggaaaacagggctttccagcctggctttaaagaggctggtcctcaggccagcagaaccagcagcacctgggggtagtttgtggcgcacaatctcaaggcctgccctagacctactgaactaggatctgctcttagcaaggtccccaggtgacttatggatgtattaaagtttgagaagccgtcctcctgcatgcaaaagtacagaatgagtatctgtgatctgaactacatttaaatcgataatgcacctcttaaactgtctttgttcaaagaacttctatcctactgagctcaaggagcaacacagtttctagcaagataggtgcaaagaaaaattcactttcaatttcatcaactgcttcaagaggttgcagggactggctgacctggtatcccagctcctgcaggaccgagagtgtgggaggtgggttgaggggaggtactgaattgactgcaatagatccatgagcatataaaagtgtgcgtgtttgttcttattcctgggagaaaatatatagtattcacctaattttaaaagagttttatggtttaaaaagttaagaagagctactaagccatgaaaagacgaggaggaagcttaaatgcacattactataccagataagaaaatctgaaaaggctacatagtgtatgattccaaccatatgacagtctggaaatggcaaaactatggagatgtaaaaagatcagtggttgtcagggcctaggaggtcgggagggatgaacagacacagctcagtgaatttgaggggcagtgaaactaatctgtatgatattataatggtggatccgtgtcatcacctgtttgtccaaacccacagaacatataacaccaagggtatacggtgtttatattaaagtataaccctaatgagaactctggactttgggtgataatgatgtgttgatgtaggttcagcccttgttacacgtcagccacccatgtgggaaaatgttgatagtggtggaagctatgtatgtataggggcaggaattatatgagaacacttgtggtatatgctcaagtctgttgtgaacctaaaactgctctaaaaaataaagtctgtaggtatctatgaaagcgcagacacatggtccgtgagagcacgtcctctctgctataaattggttgtatggttacaatcatacctagaaaggagagaaaataaagagtaagtgaataccgacatgttcaattctgccccagaatacaacaaagtccctgaatcactcttgtttcattgttgccattgcttattcaattcagtcaactcgtatatgtgaagcatgtgctacatacataacgtataatgcaggatgcaaaaatgattatgtgatcacttcaagtaatttataatctagcaaacatataaaacaggcacacagataatccttacatagtaaatgcctcctttttccccaaaatggcaaggagacaaatagcaaggatccgaggacagagaggcaaaattcagaaggccagaaaggcatggagccagaaatccaattcactcgcgagtaaggtatcgggagagagtggtgtacaacgtgacagggacacctgttgctcccaattgtaatcttttctgattggtttatgcccctttccaattactgtgtccatgctaattatcaactatttttattatcaaccctgcagaggggactaagagaaaaaaaaaaactgctgcaaagtgatgctgtgttcattttgcacagaacccagaaatcctgatgaaggaaactgaattggatgccacaagccttatctcctgtgaatgctgaatgactttgtcggtgggttttacgataagatgtactttcttttatatctattaaacaagctatacagaatactggtaaatacacagaagtaaaaagaagaataaaatagataaaattttctaagttaaaagctaagggaaaaataaaaagaattatcaattgatgtgatcaaagaaaaatgtttatctcatggggtgttggaaaaggaacatcataaaaattaataggtagaataatcatcaaaaacaatctgcacaacaaatattacatagctgaggggaactatcattaaaatataatgtatacaaattgctgagaaactcactacaccttctaaatcatgtcaaaagagttgtttgcatataagctgtctgcacttcttctctctctctctttttttttgttcatattcactgcaaggtggcttttgtccacccatgcaaatcactcatatgaaggtcacaatgatgtccaggtggccaaagcctgtggctaatcctcagtcctcatctcaccgagacagcagtttcttagcccttctcctacctccactggcttctcttctcagctcctctgtagttccccctcctctttccaacctgtatgcattggaggggcccaaagctcaaccctaatgctcttctgcatcttggtccctaggtgatctcacctagtcacccagcctcagatagccttaggcttaggaatcacaaatatatctctcacatgacctctagactcatatcaacctctcaacatcacaatttggatatccaacaggcatctccaactcaacacagccaaaccccacttttgacttcctgctcattgcaactgtcccctcttgcagatgtcccttttagagtaggtggcaccatcatatacccagttacaaacaaaatctttaaagtcatccttgactctcctacactgcatatctaatccatcagcaaatgctgtcttttccaccttcaaagtagatccccagtctgatcatttctcactacctcccctttcgctgcctggtgcctggcaatggcctcctaattggtcttccctgtttcaactcttggtccccctctagactgttccccacacaacagccaacatggttcttttagaacttcaaccaatgtaaattatacttcaagaaagctttaaaaaattcaatcagatcacatctgctatgaaccttccaatggttctcctcccgcagtgtgccaaataaaatggaaatgcccttatccttgcttaacagaagtctacaacacagcctcaccagcatgcctccaactcacatcctgcagctttaacctcactccacgccagcccccagtctccttgccgttacttgaaagtgccaggagagctcctgccaaagggcctttgcacatgctgttccctctctctgcaatactcttccccgtgtgatcatacggctcatgctcccactcccttcgggtctcagcttgaatgtcacctcctccctatgaccttccctaacctttcgtgtaaaattctacctctcccttcctcagtctcttgcttctcctgctttgttctggagaataccaaccagcaccacctgatttgtaactattcccttgagcacattctatctcagccacgggaatggaagcttcatgcaggcggggacatcatctgttcagttcatgctgtagcccagcaattctgaatgattagattgaaattggatccaaaaatatcacaaatgagataacgtaacttgttgataagtgtgtgaagagtatgaagagatgatcaagctcacaagtttccaagtgctaacatctataaaactccattgtcacccatcaaatcagcaaagattaaaaaccacaatagaatgtgataaaatagtgctctcagatacttcctggagaagtatagatgggcagaattgggtgatctggtatcaatgatcattctttcataccaatacaccatgggattttgcgatcagaaggtaaagaagacacagaaggaaaagaaggtgaagattaaaccagcaaaaacccataataagtaggacttcttcctattcattagtaagaaagagttgggtgtccccatgggaaaatgctaatttagtgtcctgaaccactgtaccctccaattcctgcttcccccacaacagtggccccacactgagtcctacaacgaggataatgatcctcaacccccaattgcacagacagggctaagtcagagacagtgatgccaaccttgctgatgtctctaaaacactcaactactgggggctaaccctaagcaaaattattgactccgattcctaagttaatttcctataaggtggaagaagcaacaagtgtcacttctcttctgggctctatgacaccaaatagtggagccgaagagacttgctgatgttttgaaacccaaggccaaataatgctctctaaacccttagaggtgtgactaggatattcacagaagccacgcaaaagacagcagccttcaatgaagaaacaaagaaacaaaaaacatggttccttttataaatatttatcgattatctaaggctaggttaattgttgataactatcaattatctgagcaagatacgcagaaacacttcaggtgcttgaactgcagcatcctgggctccaacccaaacttactggagaagaagctttagataccaggaatctgcattttaaccaactcctcagggaaactgccccagagggggtctaggctaaccatgcgcaacttccacccattctcctgggaagtgattgtgaatctcctccaaacccctcttacacttcctgattaagttggtgccccctactgaatgtcagcctcactgaatcttaacgaggaatcgccagactgggggggggattgtgcagcatgtctggggaacacttcactacttcactaaaccctgctgcacacatgctgaacaccgttccaaaggctacaggaactgagcaccgcattggaatctggccctggagggtgcccagcatggcgaccctgaggggtgcaggaacccagtgagaaggagaaacagaaggtacagtccagctcgagaccacgcacataaagaaatctgtaggcagggtctctattattgtgccatattaaatatcttgatattttaaagcaatattatttttctgattataaaagtactcattgtagaaattttaattgtgccatcatcctgcagaaaaatgaaagtacaaaaaacgaaaaagcagctatacacggccacaaagtcacagggctcatcgggatgtgctaaccaggctggaaactgatcaaagctgatttattgagaaaaaataggcagcatatcaaagacttacatcagcttcatagtagacagactttgggggcgggggaactctgtctcttttgagtatattctcaaaaggataaactttcaccttcctgtgaagcacagttactataaatcagatttgcaaactgtgagaaatgcttacaactcaatgagtcttttgtcagccagtgggggctccatcgtgaaatccacccttcgccatagcgatgggataaatcatcaccagccccgagacatcgcctaatcccttcctcgcaaggcagattcgggcgctttctgcatctgcttcgtgttattgaaaagagctcggctcatctgctgggctctcaggcttcacagtgacctcgcacagaacgctgctacttctgaaactgttttagactcttccgtctatgaaacagacacagagtttaagtttagcgtcttttatggtcagaaatatttagcgttacttccagagcggcagccgtggaacaatgtgggaaagaagtgcttcagttcacttcttgggaagtactgaccctgggtcaatttaattttttccgtaagatttccccttcttacttttctccttccactgctatatgtaacagtatctccccttccactgctatatgtaacagtatctccccttccactgctatatgcaccagtatgctagtatacaacattatagattaataatatgctatattgtttaaaaatattaatgttatataattaacatggtgtgcatattattatattgacaatacgtaatgtgatgtgataataagtctcactgagtgccaggcaccgctttgaatgctctaaactcattagctaatttattcctcgtgattctatggggtagatgcactatttcattcccattttacagctgaggaaactgaggcagctagtaacaggtggagccaagcttcacactgagatcatctggccccagcacactcataaaaatgagcaaaagtataaaagccaaagggaaaaggaagccaaggggtgaaaatcctaattacaaacaaatcctgggtaagctgggtttttagtccttccccacatgtgaacagcaactagaaacctgaacagtgactttgtttcccctgtcatccattgttggtgcctgatcctcacacaaaatcttacggagcagtatctagtgattagcttagctgaattgagcctggacacccttcatgagctggaggacagaggacgtgtcgatggagggtccaacttcaggcatctgtactcgcctgctacaggtgagtggacctatgaacccccagcctcatcaagcacccgagggtcacctgcctgcttcacctggaagagacagcaaggtgtgatcccaggaagatcctctgccaggaggcttacaggcagaagcagcggctgctgaacatagatgctgtcggcaggacacaggggtgatagggggtgagccagtggagcaggtgaaggtgcagactacaggcagcccccctgagatcctgcccagaccccagcagcagctcccctgtccctctctagcagcttcgctgtgcccgaagtgtttgagaacaggtgacccatgccctgagtggcagatgctgtgtctttttgatcccttctctccctccccccccacccccagtggggtacatggaaggtttgctaaatgtttgttgaatgaataaacgagcccaagtcagaagcagtctccaaatcattcctcatcgcaaaagggtgcggtggaaaaactcacaaagccaaggcaggaggacacactcaacttggaaacggcccgtgcccagctttggaacaggcacagcctgagcttcaaggaagtcacttgaccagcagtagctcccacctttccttgcagctagaacagcatcagaccaagtgatctctaatgtgatgatttgctaaagtacaatgagttttacaactagaaagtaccttcctctcaagactgacttcactatgagccacctaatttttcctctctcttcttttggtatttttgttgcaaatagtacacacaaaacaggatatataatctatttgtgcaatttaaagaataagaagcaaacacctttgcaggtactccctagtccacaacagtcagccccaggacctcagaagccccttatgcctttcccctaaaactctcccctccctgacaaggtaattccaatgctgagttatgtggttttttttccttatttttcttttcaacacatattacgtttctctgaataatatgctttttaatgttgcctctttttaatctttatttgtggaatcatattgtatgtaatctgtgacttttttctactcacatatgagaaccatccacactgatacatggctacagatagacacttggagtttatttttcactgctgtatagtactccattggtggagtacaataggtttatgtatccacttttctgtagatggacacttgggttgttctgtttttgctcatacatacctcctggtgctcaggtacaagggaatacagacccagggtgagactgctggatcacaggctaggcacatcttcagctttactaggtaacaccaagccaatacaaaagtgcttgtacaaactcatgctcctgccagcatggaggacccactgtgccacataaaaacatcactgttattaacttgttttatttgcatatgattattttttcccttatccccaaccacttctcaaagcaactagccagcatgtgccacacaggcaagcacccactccaatgtgatctatatggttaggtatgtatgtaccctggaaaaccctgtgatgttgcttgaggagtatataacttttttatgtatgtaagtagcatgtgctacaaagcgcgttctgttttctgtatttttcactccactcagtgttttgtaaaacatgctcatgttgctccataggtatcagagacaggatgatgttttatctttaagatgggtacgccaccctcattttatagatcacagtgatagctcacaattgtttagtactcagtggggtctaaatgtactaactcgtttaatctcccacgaaccctgcaaaacagatgcttccgtttcatataaaatgagaccaaggcacaaagaaactaaggaacttgtacaaaatcaccaagttagtaaacatcagagcaggatttgaattgagccagaatgtgttcttatccacgacatgaaactggataagaatgcaaagctcagagaattttcatgactagcatctctgggattcacagctggcgaccacggagcagaactaatatacagatggttcccctctcagtccagtcctcattccatcggctccaaaatgtgtattattctatatgattagctggtgaacaacaaaggcaattagttagtcctcttcagcaaatgttagtaaatgaaaatattatagagacagaactctttttaggaaatgcaatcatgtgaatttaaaaatgctttatcagaaatagaattaatgacaaaaatatttataggatcctaagaaaatggatttgctattttttttgtcggctgatgataatcatctgggtgcatctttggttgtgacagctccaccccttcagagagttgtatcttcatacacacctaacatgctaagagtagatgtgcatgatatggtagttagtataatttctgtaataaaaaaagtacttggtcatgcctgtaatcccagcattttgggaggctgaggtgggaggattgcttgagcccagagtttgagaccagcctgggcaagatagtgagaccttgtctctacaaaaaaaataaaaattagctgggtgtagcggtgcacacctgtagtcccagctactcaggaggttgaggcaggaagatcgcttgagcctgggaggcagaggctgcagtgagccataatcataccactgcactccagcctgggcaacagagcaagactatgtcttaaaaaaaataaataaaaataaataataaataaaaaatttttaaaaaaggtacctggaacggcctgcaaagaaagggaaatcaaattatgcttcaagacagtcactattatcactgacagagaagcagctaaaataaacagcctgctcattttgtttgtaaatgaattgccacaattcttgcactatttaaatcaagaatattttatattccatagttttcaaccacccctcctttttttattgtttccagctccttaaacatataaaaggataaaagccatttgttctggcagaaaagagtcatcataaattttgcagagtgaatttctctaagatgaaaggaatgttcctctcctccaggacagcctacggacaggactgtgatgacacagagtcttcacgggaatcacacctgcagtgttaagccacttctgtggaaaactcaagtccttctcagataacaaaaacattttagtagcaatgaaccaaaaacaaaatcttccactatatatgttaatacatcaaaaggaaccattcatgtgccatttataagaacttccttccggccaggtgcggtggctcacgcctgtaatcccagcactttgggaggccaaggcaggtggatcacgaggtcaggagattgagaccatcctggctaacacggtgaaaccccgtctctactaaaaaaaaaaaaaaaaatgcaaaaaattagccaggcgtggtggcaggtgcctgtagtcccagctactcaggaggctgaggcaggagaatggcgggaacccaggaggcagaggttgcagcaagccaagatcgcgccactgcactccagcctgggcaacaaagcgagactccatcaaaaaaaaaaaaaaaaaaaaagaacttccttcccagaaatcatagcagcgttcctcagcccaaagccagaagaaacttctcgcacatgaaattttacttcaaaaactcccatatcaggcattttaatgaatcagtggaagaaaattatcctcccaactttgttgtcaagaaccccaatttcatatgcagaaaaaagaattacaaaaataattattcgaattctaattggtgggattttgataggtttataaaggaaataaatatctttaacacaattctacctcgcagccaacatcagctattagcaaccacacttcttattgccagttcatctctccaaacacacagaagccatgtgagttgaaatttattttttaaaaactctcagttatgatttctcaaaattatatttcatatattgacatcaaccaatatgatgatgatattatatattgacattaaccaatacgatcaaccaatatgatgataattgtagggaaaagaaagagagatctgactgttactgtgtctatgtagaaaggaaagacataagagactccattttgaaaaagacctgtactttaaacaattgctttgctgagatgttgttaatttgtagctttgccccaaccactttgccctagccactttgacccaacctggagctcacaaaaacatgtgttgtataaaatcaatgtgtaagggatctagggctgtgcaggacgtgccttgttaacatgtttacaagcagtatacttggtaaaagtcatcgccattctctagcctcaataaaccaggggcacaatgcactgcggaaagccgcagggacctctgcccttgaaagcggggtattgtccaaggtttctcccatgtgatagtctgaaatatggcctcgtgggatgagaaagacctgactgtcccccagcccgacacccgtaaagggtctgtgctgaggtggattagtaaaagaggaaagcctcttgcagttgagatagaggaaggccactgtctcctgtctgcccctgggaactgaatgtctcagtataaaacccaattgtacatttgttcaattctgagatgagagaaaaaccgccctatggtggaaggtgagacatgtttacagcaatgctgctttgttattctttactccgctgagatgtttgggtggagagaaacatacatctggcctatgtgcacatccaggcatagtaccttcccttgaacttaattatgacatagattcttttgctcacatgttttttgctgaccttctccttattatcaccctgctctcctactacattcctttttgctaaaataatgaaaataataatcaattaaaactgagggaactcagaggccggtgccggtgcaggtccttggtatgctgagcgccggtcccctgagcccactgttgtttctctatactttgtctctgtgtcttatttcttttctcagtctctcgtcccacctgactagaaatacccacagttgtggaggggaaggtcaccccttcagataataagataaatcagagccgaaaacatagttcattcctgaaatcaaatatagaacgtttctaccaacacacattttcaaagatggtgttttcaggtttgtatgggattgtttcacctttatgaattagctttttaaaacctgtaatactttcttgctgacttcatcatttccttctggttgcctggaggggtggtgtggaatgctaataaaatgaatttcagttgccgtccctcacaatctgaactatagaagatatttattgtctcaacttccctatgagcttttctttgcatcatgcagcttcatggtcagcagacactaaaaattaaagaaagtctttctcccactttacttgtgtagcacagacacactgatcaaatatgttcccagcacttccgaagaaaccttatcacatccacaagagatttcctacttgcactttttttgataaacacaaccatcatagcccaacaaaacatcacacagaaatcaaattatagtgtccccataagcatctgctcctctatggccttgggcaaaatttagaatcctcgacatccctagagttaccacaatctctgaaagtgaaggagcacccacaaagctcaaggaatgcattgaaactcttattacttccaattccattttcaaaaaaagtaaatgtgtgtgtatgtgagctgcacatggtccagaatgcctcaccaaatgtattgttttaaaatgtgtgtacgtccatgtgtaattgtatgtgtgggattttgaaaggctttttatattttattcaaaaaggtacacttttcaatatcacaaactttgctttcaattataagcccttcccattttcaattaatgttttaggcaaggaatatacattagtaaaaccaaccacaccacttagggaaaatgaattagtatggggaaagtgaagaactggccatgcagtcaattactttggccagcatagatatagttgaactaaccagcacaggtgtagacagcctgtttggataaggtagcttaagccccaattttttctgcagtctttatttttgtcaaatatatgaaaactaccatctcatttcctccctgtagctattacccacatgtatgtgtagtgtcaaaataaatggccagagtcctctcagggacctcccttggcacaagtcgcacttcctcaccctctcacctccagagcctcaggaagtgcaggtcagaaagcagccagggcaggtgtgaggtgatggagcgctgagtgtcggcgagcccagataaaacaacgttccaacatcggaaatccaatcattcacctacttgtctcctgctcgctaaccccaggcaagtataaaggagatggaattataacaggagttagaagaatttggatgtgatttcatatattaactcagcaaaattttttctgaaaaggtccagacagtaaatattttcagctggcaggccatatggtctttgtcgaacctactcaactgtgccattatggagtgaaggcagccacagatgatatagaaatgaatgcatggggctgtgttccaataaagctttctttatggacactgaaatgtaaatttcatgcaatttacatgtgttacgaaatatgcttcttttgatttttcaaccatttaaaaaagtaaaaaccattttcttagctcctgggctgtgttgactgacccctaattaactgatatgtgggctgctatccatgaaaacctaggcacagaggaaggcagagctggcttcccagccaagacgggacttaccttgatatgagctgctgggtccgggacagtctgaatcatgtccttcagtaagccagcccatctaccagctgttcagaacctgacggctagaagacaaaaggaacaacatacataataataaacaactgcatttctgtgttttatgttctagcaggacaggacacaattcaccaatggcaaaagaatcatagctttacattaaacatgtttgcctaaaggcatcctctaggtacgtgtggtccatgaggtgactagataactcacttcccttccattgggaaaatcacttacaatgagcccaagagaaccctagtccgacaggacagaagaatctagctcaagctaacccacatcacatgcagcatccacacatccttccacgtgggcagcatctaatgagggatccattaaaggaagacgtgggactaaaacagggcatacttctctatcatactgagaaaacaggactttgaaatcccaccaaaactcatgcgatctgcacatccttttcagctttgttattaagttcttagtaaacagcacagctaccattcattgagtacttcagcgccagttccttgagcgctaagggctccacacacattttctcatttcattccaaccacgactctgagagctgtcattcccattgtccagctgtggacgtcaagactcataaaggttactgatttgtccaggatcacctggttaataagcgacagaaccaaacttcaaatcagattaggctatctgactccagagcccaaaaaaaatttggtttgacttaattagcaggtatcaacccacattttgaagggacattttaaaacaccgcttaaataaattaaatttaaagatgcctataatccaggaattttccagaaataaatacttcatccaatatattcctttattcaaattataaagcagcatgttctgaccactgtctgtgccctccccttccaccgagccagtctccaacctccctttgctgtcacaggccccagggctgacctctacagatgggctcagcagggtgccttgcctcctggccacctgtcagggttggttgacgtggccccctctggagagcaggggtgagaggagaggggtatctcttcccctcaccttcccaccaccgacacctgccgcccaacctccctgggcgcttggttatggttctgactgcagctggattctagggggacctctcccgtcatggggcccctccttccaggctccagcctccagtacctggtccccagccagtctctggtgctctgcagatctcagccaagccatcagttcttttttggcactaaaaatgccttttttagtttacatttttagaagccatcacttgctttttatcacctgtagttttttgtttgttttctcctttacaatggctctttgcagtaacaaatgcaaaataaaaataaacaatatgattacagaacttgagacattttcgaaggctgtctttcaaatttgctactgagcgcattactgtagtgacaagtgaaagcattcacaggagtcctccccacattcacatctgtcctttctgacctctcacggtacaggcacacccattccaacccaattgcctctcatgaagagcatctacctccagatctgcatgctccacatctgtcttcagtctccctggaggcctcccaagattggcggagcttggctcaccaagaagatgacatgctgggaaccttaggcattttttttctataaccaaatttctaggtcttggaaaatatgtacttccccccacccccacccccaggcctaaagtccctctgggggatgagagttactgaaagtacagagggagtgaagtgcagtcctgaaattgaaccgggaagcagatgaaggtgaccaggctcctggtgctctcgtgggagaagaggctgggagaggatggggcctggctgaaggtttctgggagcataggaatcctcaactccccttatcctaagagcagcaggtgccacaggaaaacaccactctgctcctggggtcattcagcccggaaggggagcgtctgcaagccatcctcacaaagggagggcgtcccactgcacaaccctgctctggggagcacatggctatttccgtatgtctggacattctctctggactagttcactccgcacagttcctccctgcctgcacacacatgctgacgctcacaccagggactgaagctcgtccccctcccctcaaacccaggctgacctgtggctgcctctgacctgcagaacacagcagagggaaggtttcaggagtcccaggctcaggcctttatggaagtgggagcttccccttcctgcctcctgaaaccaagtccccataccctcagcagcacagcacatggcagaggaccgagtgcccagtggggcagccagcaccaacgccaggcccgggagggagttgtcctggacagtccagagaactgactctcagatgaccacggcccctgccgacatcagggaggcagcttccagctgagtccagtcagcccacagaatcatgaccaataataaatgggttgttgtactaagctgctaggatttggggtagtttattacacacacaggtcattgaaacaccctgtaagtgctctagaggcacggagaagatagagggtaaatagcttgtttcactgtcactatggataagtacaaagatggttccaacactcaactcctcctgtacccatgctttttgccacataactttgtgattcttcccattaaagaggtagaattacttcccaacccttatttttgggcggcctatatgatctgcttcagccaacaggcagtagcagaaagacaagtatgacagatcctagctgaagcctcaggaggcaggacatgttcccctttgcttttctgtaactttccaccagcatgggaacatggccagatgcatgcgggaggatgagaggtacctgaggcagagtcacccaccccaatcaccccaccaagactacgtttgatcatcccatagacaaccaaaaccccagacatgggagggaggcaaccagaccagccgctagccaagtccaaccagaatggccaacccacaggctcatggctgaataagtgcttactgcttgaagccactgaaatttggggaatttgttacacagcatttttgtgacaatagattactgacatacactttgcaatgtacaatcagattaccgagatcttcgttaaaatttttctagccagtgataaaaggagactcaaacagggcatttcaaaggaagccacttcatcccaacacagagacataatatttccactcacctacgagacatgatctcaaaccctaatcctgccctcaaaatgggtttggaaactgaaggataaccaagaaacctccaccagaagcctccatgggattcccagagcccttcccaggagcaactgaattctcacttcacatgatgccctgccagcctcccctggattccaaaaatcaaaacatccttggatatccaagaccgcagcaacatcatagaagttacagcagccactcggtctgtaaccaaccaagacataaactaaatgagcaactgtttgagtctcttgtttcttatggggaagttttgagtactcaggttgcatcaagtataaaatgacagggaagggaatagatagagattccagatgcaacacagtcctgatccttgagggatcgagatgggaaacagatctgtttcatacagatatgaagcggtcagtcctgagagcaggcagttagtggaggtgcccagtgaggcgtgtggatatacctagaggaaagagagagctgattcatgcagagacaagagggtgccaccaaggagccttgatgaacaagaagcatgaggactggaggaaagagggtgaaaggcatgaagcagggaacctaagtttctcccagctctgccacattagagaccaagggcgtatgagcttctcacaccgccaccaccagagtgatcacacaccaaagggattcactcagcacgcagcgtgatggcactgccaccctccacaccagctcagcgaaaacccaacggacctaaagaccaggagaataaaagctcaaccaccctcccctgcctcctcaacccacacggatctctgactctttttttttttttgagacggagtctctctctgttgcccaggctggagtgcagtggtacgatctcggctcactgcaacctctgcctcccgggttcacaccattctcctgcctcagcctcccaagtagctgggactacagccgcccaccaccacgcctggctaattttttgtatttttagtagagacgggatttcaccgtgttagccaggatggtatcgatctcctgacctcttgatccacccgcctcggcctcccaaagcactgggattacaggcgtgagccaccacgcccggctaattttttgtatttttagtagagacggggtttcaccgtgtcggccagatggtctcgatctcctgacctcgtgatccacccacgttggcctcccaaagtgctgggattacaggcgtgagccaccacacctggccctctctgactctttttgcagccatttgagtgcctgttcttttttaccatttcagaggtattttatggattttttaaagagtacttctaatttacttttgtgttcctaatggtcatttctcaaatatgtagtagttggtaaccaaacaaactaaaaccatactaaaaatttttagtagttggtgatagtttcatgtcactgtaggaacctttttattttctattttacctgcctttgaacccttgcagaacttcactctatgttgattgaaaatcatttctttaatacttgtttcttgcaataaactcatttgctaaggtatatacttccatatgattttgtgtttcatgacccagctatattttattattgggtatcttaaagaaacaaaaaaggccttaacaataacagaattctacttgtgtcacttctttgtttttgttttcaaaatgccaatgtcttactaaatagaaacaaacttgatttgaattacgtaagctctaaccacataaaaaagatggactggtacccaaggtagaagggaaaataagcattttgtaattatggaggcagtattgcaaaatggttaagagaaggcctaaatatttgcagggctggtgcaagaaaatagatggaagtttgagacccctcgaccctacccctcctctcttctcaaacccaattgtgttctgcgggttaggggatgcatatagtcacgtggacatcccgatccacatggccacactccattcagcaatgctccctgctcatctttcagacccagggaaacacacacaagatcttcccaagaagatgaactccaggaaacaggctggtgcagcccaaaagatgctcagtcaagtttggaaaggcactctgggtgccccagcacctggggcatgtcctggaatggggatgggttcagctggggagggcaggaatggggcctagaaggcataggcaggacgctgggctgggggcagtgctcgatatgagcacagtgcagagccagatgagggatggaaatcagatctgccacttactccttggaaacctataaatgatcactttatcctccaagagccttagttacacatttgcacaatgaggataatattactgtagtataataagaactccatttgcccttgtctctcgtttctggcatggagctcctaaaactctgggaatttcccaagtgatgggagcatcttttgttctaagaaggcagcaggttggtgagtccctagatagcttcaggatgggggctaattgcaagaaagagtgagtcttgattagatgctcagaaccttcagccccatttcccaacctctcaggagaggagaggagctagaaattgagttgatccccagtggccagtgatttaatcaatcctgcctatgtaacaaaatctccataaaataccctgacggggttaggacagcttctgggctggtgagcatattggtatgaagagtgtggtgcaacccaatgctaaagggacagaggcggccaggcgcggtggctcacgcctgtaatcccagcaccttgggaggccgaggagggtggatcacgaggtcaggagatcgagaccatcctggttaacacggtgaaaccccatctctactgaaaatacaaaagattagccgggcgtggtggtggacgcctgtagtcccagctgctcaggaggctgaggcaggagaatggcgtgaacccgggaggaggaggttgcagtgagccgagatcgtgccactgcactccagcctgggcaacagagcgagactccatctcacaaaaaaaaaaaaaaaaaaaaaagggcagaggctcctgtacttggaatccttccagaccttgccctgtgcacctcttcatctggttgttcattcatatgcttaataataaactgtaatcataagagcatagcgttttcctgagttctagcaagttgttgcacctaaaaggggggttgtgggaacccccaatgttgtagccatgtcagacagagtgtaggtaacctggggacccaatacttgtaactggcatctgaagtgaggacggtgttggggagctcagcccttaaacccatgtgctaacttccggtagtcagtgtcagaactgaattgaactgttggacacccagttggtatcagtgttgaatgactggttggtactggcgaagacatgatgtatttggtgttgggaaacatgaataaaaaatttgtaaaacctccaaacgatgttcagcaattcacaaaggtgtcagtgcaagagttggcctgtatctattctaactggtcagtatgcaagttgaaccattgtttgattatctcctctgtctacaccatcaggcttttgtgaggattaaactaaattatgcctcagaaagaaaactctctcaaggctaggcacataatcaacactaaacaagtggtaatcattataattaagaaagtaaaaatatttcaaatggacgattttgatactgtataaaatgttgcaacttttttttttttgagacggagtcttgctctgtcgcccaggctggagcgcagtggcgcaatcttggctcactgcaacctccacctcccgggttccactgattctcctgcctcagcctcccgagcagctgggattacaggcacgtgctaccatggctggctaattaaaatgttgcaactttttaggaaaaataatcctcaataaataaattgctaattttcataagagccctttgtcaactgactaaaaacatccttaatttagaaatgtattttttagttttaagataactagtcattaagtgaaaacattgtaggcaaaatggctctaagcaatttagtattcataggaatgaatccattccttgaaagcattggtcgctgggtgcacttgtcctggatgagcagatattaggcaaatcagtctttcaccagcaaaccctgccataagaactgcacaggcctgattcctgccaagcacaccaggcccctgactggggcagaggcctcccttatggggcaggaagaaggaggcagggagaaacatagggcccatgatttaaggaggctctccctctcaggctcatgcaagtgcaggatcagtacctaaaggggagcaccgcccgaaatcctgtgccccagtcaccttaacccagtccagccctggctcctgcactccaaagctaagcagggaataccagcgggagacagaagacagcatgagaaactgaatgcatctcccacatttatctaaaaataagaaaatggacttcttcagtaggaaatggctcatctttccaaatgaataaaaatacttatagctatgggttgaattgtatcaattctctcccccagttcatgcactggagtactaacccccggtccctcgggatgtgatgatagagaggtagggcctttacagaggcaatcaaattaaagtgaggtcattagtgacctaacccaatgtgactgatccacttacaaaaaaagggacaagatttaaagacagacctgtatagaaggacgatggtgtgaagacacagggaaaagacaaaagaggcctggaacagattttcctcaaagccctcagagggaaccacttgggctgacaccttgatcttggacatccagcctccggaacggtgagatgatgaatttctgttgttttaagctacccagttcatggcagtttgttacaacagcactgggaaaggaaatcacctctatggagggacttacgaaagtcacttaactaatgcagattagaggcctcacagtcagggcatggcctcaagagccacatccattttaattgtaccatttctcactgaactctgaccctggtcaaggcatgtctcaggctccatggactactattccttccactgatcgaccctggcttcattctggcaagggagggactcatacattctgcggcctgcatgagtgtcatgtgagcacccccataaccttgatccctgcggtgcttctccaggggagccctagcattccagctggcctcatgggcatgccttagagagagggagctgaccctctccttcttcaactggattttatttttattttttggcatgttttgtgaatacaaagattcactgcctgggtgtgccccttgaaagaaggtttcaattgcattcaggtgaaataaccacaaaatgactgtaagccaaatgtagtagtatgatagaaaaatggaaatatcgtaaaagcaccagtctgtagacacctagcttctggttcctctggaaaagggagaagagagtagacagtgatggagaaaagaggggctgtgaagactatagaactgagaaggcagtaattctaaaatctccacactgtagggccaggaacaggcagtgctgggcaatggggcatcttatctcagggaagtcaagggtgtcatgtagaaccaacataattcatccaagtacagcaaagaatccagaaatggtctgtggaggtttggaaccatgaaaatcaaataggaaagatacaaaatatttacatatccacattttttaaaaggggtcctgactaggcagcataagattatttgggttctgttcattttacctttagttgcccttggttctgccatcttttttctctgtgagtcatttgtcttgcttttggtcaacacggctttcctcgggtctccaaagatcctggaataacctgaatataagttgaagaatattaaaccttattttgttttcaaatattaataccagggatcaactgtacatgtaccgacaaaacctatttcttaaacattattttaaaatatcctaaaaggggaaagaacttaaatccttccccttaaaaaaagaggggacaacattcctctcctctgagggaagcccagcattatgaagcaaaaatcgggagtgaaagcaaggccaagcctaactggcatgctgaagcacacagatgcttttgcacagaaaatattttgaaaatgttttcttttccttatagcccccagctttggtaataatggcttccctagatcattctgttagcactttctgctgctcagaacagggtagtgggatttagaatttagaaaacatcccgagaactgtaattaagcaattgtcatagtcccagaaaagaaacaacccttttactttgtaaatgctaggaggatctgtattttttaaaatcttagaacactaactagctaaaaagatagaaagaaaaaaatctttcttacaatatgcctgtagcacggctccaaaatccagtccctctctctcttcttttttttttttttttttttttttttagatacaggaatttcttacacaactttccaagtaaaatattcaatccccaaataatatatttagtagaatccttacaacatgagaaattgtaaatggcatctgtttccgttgaaaatatttttaaattagaaaacatcttaagcactgcatcaaatcaatatttgtaatgggcagaattatttctaaatggttccacaggccagttgacattcccactctacttaggaagcccccagccaactccacctgaagtcttcgaaacctatgcatagaggcaaattgcccagatgtcacagaaaagcatttgttgtgatacagaaaataaaacacattactgggggaaaaaaatcagggtactaaaccacgtacataatatcatcccaatattgcacaaagaaaaaaaaataagtggatgaaataaaagagggaaggcaggaaaggaaagaggatgacctgagaaaagttatcaaaatggttaacagtcatggtctttggctttccagtgtgaaataggagttcttattttcctctttttaaaatatttttaaaattatttattttttaaaccaactaataaaagtaatatatatttaccgtgtacaacattatgttttgaaatatatatatatatatatatatatatatatatatatatatatatatatatatatatatacatgttggaatggctaaagtaagctaattaacatctgcattacctcacatacttatttttttgtggtgcgaacacttgaaatctactcttagtgattttcaagaatataatgcattgttattaactacagtcaatagatcataggtctattcaagttcaagtcacagatctcttgaaattactcctcctgtctaactgaaattttgtgtcctttgaccaacatctccccagttcccctacgctcaacatcactaatcatcaaggaaatgcaaatcgaaatcatgatgagtgtcatctcacacctgttagaatggccattatcaaaaagacaagtgttggtggggatgtggaaaaagggaactcttgcccaccgttggtgggaacgtagatcagtacagtcattatggaaaacaggatggaggttcctcaaaaacacaaagatcaattacaaaacaaaatactatatgttttacaaatgtactacaactcaatttggtatgtattacaaatcaaaatactacatgattgctggcaatcccactctggagatagatccaaagaaaatggaaaatgaaatcggtatgtcaaagaggtaccagccctcccaaattcattacagcattattcacaacagacaaggtatggcatcaacctaagtgtccatcaacataaacgcccataaagaaaagtggtgcacatacacaatggaacactattcagcatttagaagagaaatcctgtcatttgtgacaacatgaacaaacctggagaactttatgctaaatgaaataagccaggcacagaaagacacatactgcatcctctcacttatacatagcatctgaaaagttgaactcctatttccttctttatagttttgtgtattttccaaattttctaaaccaaaaatattcatctttataatcaggggagaaaactaaggaataatcattttataatcctaaacatgcttttaaagcatttatttcactgtaatgtattcttttcccatccagtcatacatgggcccaaggagctggccttccctgctcggcagcctgatgttcaaggggatgggggagggggacggtgcagtagatcatgctttgcaaagctgtgcaaatcttttttttttttttttgagacggagtctcgctctgtcgcccaggctggagtgcagtggcacgatcttggctcactgcaacctccgcctcccaggttcacaccattctcctgcctcagcctcccgagtagctgggattacaggcgcccgccaccacacccggctaatttttgtattttagtagagacggggtttcatcgtgttagccaggacggtctcaatctcctgacctcgtgatccacccgcctcggccaaagtgctgggattacaggcgtgagccacggcgcccggccaaagctgtgcaaatcttgagttaataaacatgttccccaaatccaaaagccaatattgactattgcttggttaactgttttgcatggataagtggttaaaggagtatttggtttccaatttctgcaaagggaataaaagttttaaaagcgtgaactaagatttcctatactatgctattctatagtaggtttttatgccaaaacctctactaggctgaaaggataatttgatttatggttgagacattgttgggcctgatttaaagcccagagtcaagcccagagaggattctcttaaatatgtgcaatgggtatttttaaattagcattatggcgttattaatatttcatttatcctgagagcatttacctgacaacgtaaattatgtgtaacacagctgagaagccacaaaggatccaaaaagatgtcacgaagtccacgaagagaagctttgccagagaaaggcacactaccagccgcgtgagctggcctcatcaaagcaaaaaagtcagaaaattatgtaaaccagactcaagaactcaaaaatacagtcgtttgagaacattggtaagagtgcaaactgctcaccccagctcaatcacccctggtccagcaacggcagaaagccaaggtcaaggagtcacatgacctgaagagacaccccccaccaccaccaccaccctccaagccctgcccctggccagtgggacaaaccacatgacccctgggattcagtattcagtcaggttctgtgttctgtatggggaggtagaagaaggcaccagatcatcaggaaatctggactggaaatggccaaagctgaacacatctgagtacctgaagggtaagcttaaggtgtcaaagcagccatggtgaggcagaaagaaccttgagcttggggccccaagtttatgctgacccactagcagccaacaaaacctccctcagcctcagtttgctcatctgaaaactgtgagtaagaggctctgactccagagaggtggtgcaagttcaatgagaaggggttgctgatggtccagatggacagatgcaaagcactgctttctgtttttgtctttgttttgatacaggattctctctgtcatccaggctggtgtgcagtggtgtcaatagctcactgcagcctggaccctccctggctcaagtgatcctcccacctcagccacccaactagctcagactataggaaaaagagtcatgcaccaccatgcctggctaatttttaaaaaaaaaattttggagacatgagatctcactattttgtccaggccaatctcgaactcctggcctcaagcaatcctcctctctcagcctcccaaagtgcttggattagaggggtgagctaccatgcccagcaaaggcattgttaaattcaggaatgaatgaccaccttgttccccaaaacactagacaagagaaccattctctacgcacagatctccctggccaccacgtgtaagcagcagtgaatattccataggtggaactggctactgtgaagaaagaaaactccagaaaagctaccctcactccaagaagtagcctggaccccacgtgcgtgacagcagcctggggagaaggctccactcccaccagcaatgccaaggacagagcagcagcagccgtccatccccacagttatggtgaacacagccacagagcagcctgctttttccatgtatagccacacacaggtggcaatggcagcagacgtaactggctgcccttcctcccttatggaaggaaacataattttgcttgggtgttctgcctgcccccacatgacccacggaggatgaccagccccaacaccagtgtaaatcctatcactgggcaccatctcttctcaccacggattggtttagggaagggcacatgatataattctggtcagtctaacactcggggaagcgagctagaggacttctaggaaaagtgttggctgatgaagaaaggccatagagtagtagtcctgtctgtgtggcacttggaactgtgagagccatcccaggaccatgagaagaggtcacctgaggataaaaccaatgtgctgtggatatctgggggaaaggagggaagtccttgtgtttctacctatggtagggaagagtataaaccaactctgaaggcatctcatggcagggcagctaggcacatcaaatgcattttccttgttaactaaaccattttgaattggggtcatttttgttgttattgttattactggcagcaaaagtatcccatacactctagtagccatgttcaaaaaagtcgctttcagctcttttaccatctgtatccatagtcacgcagacacgctgagtatgctcttcagttctaattttaaaataaaatgatctgctggaaattagctcagctcatagatctccatacttacaacaccgtatctaagaattagtaaataactattaccatgataagtggcctatctcagtctatccacatgttgagtgtccaggtactggaggtggcatggaacctcccctcaataaacaaaggctatgatgagaggttatactttaaattaaattactgagtggaggcataatgtggtgagggtcacaagagaggtaccaaagatgcagcaacagagcagttgatgggcacttagcatttcagtaagtgggaatggggaggagagcaggaaaggtggaggaaatagatgaggagaggaaagaagggaagtgttctccaaggaagcacgctgcagggaaagagtctttcacctgtatgtcccacaaggcacagagtatgaactcagaaatgttgaatgatttgtctctataattaagggatgatttcactgataatgttgtcttcttccatgatctaaattcaacctgcccttcaaatccattcattcatacaattgttcatccatccatccatccatccatccatccatccatgtattcatgtattcattcatctatccatccatgtattcatccatccatcatccatgtattcatccatccatccacccatccatccatgtattcatccatccatctatccatccatccatacgcactgagttccctccatgtgccaagcactgagctaaacactaactagggttgggctttgccaatgagttcagagcctagtgagagagacagagttgtaaagaaaaaaatcacaaatgccaactcccccattgccttgcttgatccttaatgccagagtgtagcttggttgagcatgacaatcagctggagagctttttaaaaacagaaattctgcaatccttcctcttttttctttattggaaagtccaggggtgaaaggggcaaaagagtctaagtgggagttagggaggcagaagaggattgaaggcagtgtctgaaatattttcagactgagaaggaaaaggaaaacagccaagaacacaaggaggagcagtcagagcataaggaggaaactaggaaagatctaagtcatggaagccaaggaaggacattcagtaagatggaaagttcagtgtcgcaactgcagagagattcatgtccaggagaaagtcattcaaccaaccatacgcattgagaacaggtcctggatttggcaacttaaaacctcttgctgtcctctaaaaatgttgtaggagcctgacagcattaagccaaatggctcagtagttaaaaacagggaggatatgcaaagggcaatgtaggctactcatagaagaagttgagcaacaaagttagggagggagtggcagttcaaagaaaagcactaatgccacagggtgcagtggctcatgcatgtaatcccagcactttaagtcaggagttcaagaccagcctggccaacatggtgaaaccttatctctactaaaaatacaaaaattagccgggcatggtggtggacacctgcaatcccagctactcagaaggctgaggcaagagaatcacttgaatccaggaggcagaggttgcagcaagctgagattgcaccactgcactccagcctgggggacagagtgagactcctcaaaacaaaccaaccaacaaacaaacaaaaccaaaaaaacaatgaaaacaaaaatgaaaagcactaactggcttcacccacccaacatttgctgggcacttactgtacttcagaaattactagtagctagggatgcactagtgcacaagactcagccctgccctcaaggcatttacaaaccaatgaaaagaaggtttatcttatttgctcagtctgtttgaaggatgagaaaagcaggtatgtttatagacaggataaagggagccagtggagtagaggagatagagattctagagccagggcacttaaggacgttactgtctggggaagaggtagaggaaatgccatgtttcacagcacaatggtggggtcagttctggcaggaaggtgggaccccactgtctcagaaggggtgtgctgccagatggctaacaacaggctctcacaggaaaactcctgatttgaagcacttggtcatttctatggagtcaatatttccatcatgggcaactgcaaggaacccaggggagtccctgaatgcagagttgggaaaagatgtgctctaacgcatcattgccggctctagcgagttgggaggagccagctctagcacacatgggctccagaagccaaagagagaccaagaagcctggaactgttgataagaaaagagtgttcagaggaaagctgtgaagccagcatagccagctgctctcctaggcgctgagaccctgtgatgagaggagaaaccagggaggcggagttccaaatctggaaaagtggcaggcttgagtgctcttcagttactcccacttgagcaattttgctttctaaacctggttaatagcccaaaatgtgggctgcttattgtcatctcccttcactgtgtgtgtgtgtgtgtgtgtgtgtgtgtgtgtgtgcttttcctatgtaaactgctgcaccactaactctgctatactttagaactcagtaaggcaatccttagactcttatacaattccctaaagggtccccttttactctaagtcacagagaaatgttgaacatttaaacctttaaagtgcagttttgctggaagaaaatttcaagggtctccatgaatcatgtctgagccatgtattggccatgaccgcatacttcttgtcagtcttatttcatttggttgttattgtggtttggtttcatttcatgttgctttggagggtcaacctttctttcattcatgacattcaatcaacctttctccccagtgcgtcttcccattttttatgtgtgtgtcaggagatagaaaaataaacacaggtattaatgtgcctgtgggcaccagtttgtaaagcccaagacgttcttggacccaaggaaactttcagttctttctcagccttgccgttttgcatgtaaagcatttgagctgatctcagagttgaggtggctgccagcttccaccagaacaaaacacacagcagcaaaacagcgccatgtccctcagtgtgggaaccagggtctgcctggggcccccctgtaaaaacgagagatctgaaggaaaacagacagcatttgaaaggcggatgacatcaagaaagtaaaagcaactataaatatgacttctctcctgctttacactgagccttctgttcaagaaaacacatttaccagggattttttccttaagctcaactggaaaaacaaatatttagtcattttacaagagcagacaactgaaaagcaagccacagattaaacaagcattatgtatttctaagaaagttcatcaaacacaatatatctttgagaacacaatcttgaagtctgttttagaggcaaatttgaccttcaaaatgaattttgtctcgatataattacaaggtcaaatcttaaagaagcaaatgcatagacaaccatctttgcaatgagatctgttttatatttgcaaatgaacaatactggacagaaaaaaaatacataattacttctgaggttatatataaaatacccaattggcaattagctaatatcatattagcatctcaatattttagataaagcaaaactcccaagtacaaaataatctataatagaacaaaaatggcaagtcatattaaagagagattacatataagagactttattacaagttatcattttttagataaaatttattctttcagcatcactttgatacttgtaggaggcagatatagtatagagaggcagatagaggtgagaacctttcctaagaaaaatcaagcagcattaaaagcataaagaaaaaagaagaaaaaatatttcagattcccaattcgtatatcacattgttgacaaaaaaaaaattagagaataccaacaggaaaaggtttccttgtgctctttaagggtggggaatttcaaagaaccttgaactcatcatgaaaatagttctatacccatcggctttgccaaaaacactttgggatttcagtgatgggtactgagccaccaggagcaatgaaaccagcttttccatttccactgagttttgactggtttacaaggattgcacaaagatcacctcatttgtactggacacaattgggaaataaaaatttaaaaatcatccttcatatttaaaatagaaatcatgaaccccgccacaaacatgcttccccgacactcaggacctgaggttgacaacatgcctccccgttaacccatgaagcctcataggtatgcactgcatctatatagaattttccatggactccatcatcaaagcatcctttaacaagtatgaactgagcactcaccccatgcacagagctgtggacggggccatatgggacagaaaagttgcaaggtgtgtctctcactcccaaagagcccacatgccttgcaggagaggaaggctgtggacccaggttttgtgatgcagatgaaggggccacatagctgctccagtaagaagaactggaatcatctgaaggagaggaaaatagggcatttcagccttgaatagcagaacccagatcatgaaaaataggaagaacttatatggacgtcagagaggaaggcaatccagacaacaataataacttaggcaaaacagaaatcaaatgcagcttgcagaagactctgtacagggagccaacacagctactttacgtgaggagtcaatgagaccatttaatagaagccccctgtcgaaactgtaaaaatgattttgccatcttggccatctcctgagatggctgagaagggatttgccaagcaaaaaaagagttgaggggttttgcacaatggcctggaacagagaggctggagagaaatcagacaagtctctcaggcagaagttccagaaaaatgaagaagcaggagagcccgaggcaagagggaaatggcaggcacattggttggacgatgagggtttgtgtggatctcaaagggccaagacgtggggagagtctagacttttaggctaggaagtccgaaccttgttgtgaaaatagctgaagattttggagcacctgccgagcaaagtttcccaaagaggctgttgggaagattcatgaggcaggagactacagggagggaaggccagaggcagagaggccagttccaggatggctgccacgatccagcccaaggtaatgaaggtggggaagcctcggaatgcaagagacagggtggagatgagaagacatgtcagagcctggtggccaattaagcagagaaggtgcagggaagagaggagagcaggatggaaagccaggaaatgtgggtctcagtgaagatggggagttctgtttcagccccaagaatgagcatgtgcatccttgaaccccggggcctgtgaggttggtcaatggaagcccgggagctctgctcagtcagggtctaggactggtactcctgctggggccacctcagagcagaagcagggcgggagcggtggaggctggctctgaagtgttctgcccttaaagaacagcaagactttccagaggcagtgtgtagcctttaagatggagactgtgatgaagaatggagagagatggaaagagcttctcagtgacatggggagagggtccgcacctggagggcaaacccttcctggagggcagaacctcgctggccatctggcttcccacacacctgcctggtgaaccaacatatcactagggggttcttttcttgcttgaaatgtcattgagttttcaatttgtagcattcatgaggtgcattatgaggtttattcagcattttttttcttttgctgagaaaggcacaattaagtaccagaattttctttgctggcctagccttctggaatctgaacaggttttgcaatcccaggaccagatcctctctatataaaaattggtgtgggattggggggggggggtctctttttataatagctagaacatcttaatattttgtaaaaaataagctcatcacgaacccagttaacccagcaaggctactgcccttcttctgtgtcgtggtaacagctttcttcagcagtgcaaggtgcaggcagagcctttcatagttttaatcactaggtccatttattgagagagcttgaaaggtgattattcctgttctcatttctcagaaaactgaggcatgtgaagatcacaggtagggtaagcaaatgaacacaaattcaaactcggaattcaaaaccagcctctgtgtattcctgaggaccatactgtctgctaagtgtagagaaaggcacatcctggttcaacagcagagaaagcaaacaggaggcactttctgtgagtcatctccaccacagggccctctcttttgtgatccagcgatacttgttcacagtcaaagcccaggaagagtggaaagattaacctttgtgagccaaaccgtgtgacacttgattacttgacagaactaatccttctgtcctgatgacagaaattcaactacacaggtacatgcaagctaatatctgttgtaatgcctcccagtttctctggagaattccttagtttcctggacatctctgaaatgcaaagttttggcaacgagtctctgaattaacctctgaaaatctcacccagccaagatggccttcttgagaagactgaagaacatggttggtttcaggctgagctggaagtggtttacctcccaggagaggttccccacagtggtgtttaaggcatggggtggaccaacaccaggaagactcagacatcacaccacccaccttcaactcagtcacatccacctacattttctgaaaacaaaaggcagtctccccaaaaagcactgagactcttgtgtaggtaatctgagcagacaccaacttcccagggcttccttttatccaggagagcttggctgttctttttaatggtaatatcttcttcttcctgcagcaccgggctgtggcccactctggagaaaaggaaagatcattgctggcctgccttcccaatttcagacttgccagtctacaattgtgtaaactaattccttaaaatacatctcattatatctatcatccatctgaatctagatgcatacatatgtatatacacatatgtacacagttataaatatggatcaatataatgagatgtatttttaagaaattggtttatctgtctatatatatttacatacatatacatccatacatagatatctcattttatctctatatctatatacatataaacacacgtgtgtgtacatttatgtatggacataaagatgggtgtaataagatttattttaaggaacttgaaatatagagagatatctatatatatctacacacacacacacacacacacacacacgcacacagagaaagagagagagggagaaagatctatctacatccatcctgttggatctttctggagcaccctggctgacactcctgcattgatgagtcattggttgtaggatgtcctgggaacgaggcatgagcttggacagggctgtcatcatcagcaggcacttcccaaagagggctgacagctgaggcatcttccaaccatactcccagcatctgagggaataagtccttccttcctgaagggaacccagacagcacatcacagagcccacaccaactgggcaaattgaatgtgcacagagtaaattaccaaaactgccaataaaactcagaattataaaatcatataatttagaaattataaaatcatataatttagaaattacgtgatgtaattaacatttgcaatccgttgacttaaagtcgattatgtgggaaataactgagagttcgttaataagcacaaaacaatccagcagaaattgacagcattaggtgctcaggttgtgtggaggtcaatctcagcaaaccagagtcactgggctccctagatggagttaaggaaagccctgatcttggaccagccacgtcctttacacatagcaaggactgtaagcccgaccttgctctagcacaggaaggaggagggcttccctctaaaaaccacccattttctcccagaaccccaagactccagtccctgtcaggctgcagaggtgatttccaaccatctgatgccacctgcatcagaatcgctgaggcattcctgggccccatgccccattcctggagtcagcagccggactatgagactggctcagtgaaccccacagacagggtcacaggcatggaagcgcaggcagcagagtgcaggcacagaggctagcagtgaccatccacctggccctgaacaagtccaccttctcagagttttagtttcctaacctggaaaacagggaataatatcatgaaagaaacaccaggcacagcactaatgtatcacaaatgccacataagtaactgagtgcaaaatgggacatttcctgccatcggctgaggctcagaatagcacacagagcacagcagcggtgcactctctaaaaaaggatgcccgcacatccatgcacaactctctaaggagtgacctaaataacaacagcaagtccctgcccctctgccttcccggcctcaagggtatatatgtcagaaactggtcaatgctgagtatacagctcccacagtcgcagaggggagcagggtggatgtgtagagttttctggtttctgcacagtataaatcctcccacaatttcaatcaaccaaaggaggagttgggagacatctgcacaattagctcttgtgcaccggcactgatagaagagaccagagacctggcattccttcagagaaagtttcagaggctgtgcagcacctctctccaccccagggaaagaaaggaaagggggacataggcagggaaatttcacatccatgtgcagatgcaccaacctcaaggccagtgagggaagcttcaaaaaaaccatttaggctgcctccaagggttcccctagggttctgagctaccagggcacaggggctagtgactgccttccaggtagagaagtttgcagaggctgcctggggacaggtaagaaggagaggccatgggggggcacactgagcttccatccatggtgaggtgagagggcctgggtatatccttgtacccagggacccatggcaggtggctggacttgcaggggtgagccagccctgacagaaagaggctggaggtgtaccagggtgaagctaggggaagggtaccatcagcagacacacacagggatgtcaccctgccatggagagctgtggggcaatgtcactgcaagagcccttccgcaccctcccatgcattccatgaacaaggggcagcttttagacctttgcttcacagaggggaatccgacaccaaattatgatgcatggccaagtaaccccattaatagcccttgttgtcctgtcttcctgctccaaccctggagaaccagaggcagaggtcagtggtaaggagaggagtgggtgtgcaagcctctgaggctgggagccggccatggccccagaggcgtttccgatgctaacaccagctccggatgcaaagaatcttgaaacaggacgaacaataggcttttaaaaattcaacttccctggacctctcaatacttggaaattagactgttcactgtatctagaagtgacagggaaagtctggtgcctgaggagactcggaacagggacaggaaggagctatcagacttgaggcatgagtttggaggaagtaaagttgcacctacatcataacctactgagaacagctcattcagaaaacaaagaagcccagtttctcatatgttgggtgggtggccctgccaggtaaacctgtagcaaagccacatggaaataggatagtgtcaaaaccaatcaggccaagagtgagcaacagcccactgggtctctgaaagagctgaggaaacaagaggaggcaaaagaagtgatctataaggcacgaggttggtgacagggccaggaagtttacaagagcgagcatatcagatagacaaacaccaagaggcagaagagtctacagatacaaggagatccaaacctacccgcaatccccacccaaccccgccccggctttggctaccctggggctggcgaaggtattaagtgaaaacacccaggtttgagaatggctgggcatcaaggcagttttgacaacctcagaatcaggaagtatttgcctgcaggccagtagctgggagaaatgtccagctctacgtagatttctgtagctggggtcccattttccttcaaggtgggatgggtaagacagaaaacgtcccctgaaggacaagactcaggacagctccagcctagtgtctcccggtccctgtttgctccacaggagaaagaccctccagagtgcaatgaaggggcccagaggggacagtaaagggaccccatcccatgtggcgactcccatcatggcagaactgtagaatccaacatcacatggacctcattgataacactgaccacacctccttgctcttaagatggataaagggcagggacaaggggctccgttttatttgaccaatagctgcaaaagtaagaaatcgtaataagcatggaatcacagaaccagttgaatgtagaattaaacaattaaggcacatttctggcttaaagatgccaagaggtttttgtttgtattctttatgttttttttggacaaccactaaacacacattcagagcatcttctataagagccacagagacatcccttgagacttcagatgatttcaaaactctgctatcgctccttgaaaaaggcaagcctgggattgcaacctatccatgcatctaaccccccctggaaatctctggctccaagagtctaatggtgatggctgccactattagatttcctttctctctgggcattacaatcaggtttacaaggaagaaacaccacccagggttatcacctccaccagtggacacagagttcaccagcttttattgccgggactgacagatgtcaaggggatcactggattccaggattgacaggatggaacggtcagtaggacgccttcccccaacaactcagatgacagagtccacaacgcggcagccagatcaggcaggaatcccacctaatgtctgaataacaccactgataggaatccccactgaatcccaactgaaggctcagttgtacactgtgggcccaaaatacctacaacgttttacaaaacctaaagaaaaggcagatctctttggtggcaaaggcaatgtggtgagttaactttgaagcaatccaacaccatattattgtcatagacatgctcactaagaaaaaaaaaatcatacagagaaatagaaaaatagagagataaatgaataaatatttattttgaggtttcactgccaaaggctagccagagaaacaggggagatacaaggtgaagattggaatcacaactaaatattgttcctgtataaggagaattttccctgtttgaattcttagattacttgactccccgagtttctcattcctttgacaggcacccatgagtgttacactccaagcactcaccctcctatttccatgtgccagcatttccagtcactatcttgatttaagtagagaggataacagttttctcctacatagtaactttaaaatagtaacagttttctcctagaagcaacttaaaataaatttattgacattaaaaaattttaaatgaggtgtagtcaaagcttaaccagcacttttttaaaggagcatattttactttatttttatttttatttttattttgagatggtgtctccctctgttgcccaggctggagtgcagtggtgtgatctcagctcactgcaacctccacctcccagattcaagcaatccttaaagaagcatatttcataaagaacacttctgagtcacttctgttgtcttcctgagtgctttttacctgctctttgcatgtggcataaactcctgcttctctaatgcatctcagtttttaacttttggctctttcactgcaaacataggaatttttaaaataaagaaaccacagccaggcatggtggctcacgcctgtaatcccagcactttgggaggctgtggcaggtggatcacgaggtcagcagatcaagatcatcctggctaacatggtgaaaccccgtctctactaaaaatacaaaaaaattagctgggcatggcgatgggtgcctgtagtcccagctactaaggaggctgagacagaagaatcccttgaacctgggaggcagaggttgcagtgagccaagattgtgccactgcactccagcctgggtgacagagcgggactctgtctcaaaaataaataaatacataaataaataagtaaaccaaaacagttgtacaaacaccagatattcaaacatcaaatgacttgataaatgtggactttaacggggcaggggataaggaagggaaatgcagcaactggtgcatttacagcaattaatcctccctcatcattaaaaaacactgctccattttgtaaatagcagcacagagcaaccacactggagaagtcatgcttaacaatacattcatttgtgggctttgtgatttttttccctctcaagccattttgaagaaaatctttgaacacgtctcagtggcttgatgcttcacattaagctcctttaagcagctagaagtttcctgaaggaaacacatgagccttttactcctagaacgccaagagctggtggagtcctcaagaaaaaaacgacgattccagtgggaatgaatttccttctgagaagtgaagggcaaaccacattgaaaaagttgagcttcatgcctcaactcagaaagttaacctagccagggtccaggcaagaacaaaatctgccagaaaggcagggtgagctcagacagatttcaagcaggagcacaggcaaggtaatgttcaaaatcctgtccagcccccaggtactatgaatactcaatgacatcaaatggagccagttccaaattgctaaacttgtagctcatagctgggtctcctcaagaacttgtctttagacccctaaagacacctctgccacatgaagagacccgaaacgcagcttacatccagagcaagtcctttgttaatgaaaatgtgaatggcaaagacatcaaggtctctagcagtggccatatttgaacatgttttaggactttcagataaaatccgattaaaacaaacagattggggccaggcacggtggctcacgcctgtaatcccagcattttgggaggccgaggtgggcagatcacaaggtcaagagatcgagaccatcctggtcaacatggtgaaaccctgtctctactaaaaatacaaaaattagctaggcgtggtggtgcgcaccctgtagtcattctttgcagttccttgctctggggctgcatgaaggacttccacctgtgaaaagaagtggcgaatctggggcccatcattggaaatgccagccttctcactgagtctgctattttgcaagaaaaatcaccaacagcattccccttaagtaagtctctcgagatatcacccaaggcagggaatccccaactttgctcttggatcaagaagggcccccgataaggttttcaatcatccttagaaaaataggaggaaagcggaagaacagtactcttaggcgaaattaacataactgaagtcacattcttttgaaactatgtcctcagatttttgggggtggaggttaaagtgtcctttatttgctgaaatgctgatgaaattagagaatagaggttttcctcctttgttaatgccttcacgtattggcatcttgatttcctccttttaaaaaatgtactagttttggccgggcgcggtggctcacgcctgtaatcccagcccttcagggggccgaggcgggcggatcatgaggtcaggagttcgagaccatcctggctaacacggtgaaaccccgtctctactaaaaataaaaaaaaaaaaattagctgggcatggtagcgggcgcctgtggttcccagctattcgggaggctgaggcaggagaatggcgtgaacccgggaggcggagcttgcagtgagccgagatcgcaccactgcactccagcctgggcgacagagcgagactccgtcaaaaaaaaaaaaaaaaaagtactagttttatgtcttaatagcaaatctccattctaaaatgtctacaaaattatgagaattttattatatacatgaaaacatctattatggaataaataggagaaaatgtaaaatattatgtacagtatgattacaataagaaaaaataatacacaaatgtaaaatgaagatagttacacaagggtggtataattgaggcaattttgagtttttaaataattgtttaatgtccttaaagcattactttttaattaaaagaaatttcatgtgaatgttattataacagatttataatagactttttaaattacctaccaaagcataaacatttatctctacagatattacagtatgcctttccaaaaatagtcaaataaatgttagctcttctattaccagtataatgtgtacattgttagtattactgattgtgtcctgtctaagtacgaactcaactggcatatccacattaggtcctgaagaatggcctcagccttactcaaggaccgttctctgataatgtcagcttgaatagaagcaacttaaaaatctccatgcaatttctattagcctcactcatgctgctgcaagatctacaagccatttgctcttgttgggagtgtgaaatgttaaccagaaagtgtacttattatagggcgtattatttcttttcttgcttgcttctttctaactgaagattctgctctcgttccccttaaaacaatcttcagtgtttcctagatgaaatatttttctccatctgtcctctcttccagcttccacacagttgtagacttactctcttgctgaattttcagtttttcctaccaaaataccggctatttttgttctctccttccccacttctgtccactttttaaaccatcaaaaagctatctatactaccccaaatgctttcaacaccaataatacaaaattatattaaaaatgtgatcttggagtggcacagtaaccattgtcacggggtcacaaaaatcactgtttttaaaaaatggtttccctcactgaatgcccatgctgttcctggacttcactagaagtacaataaataatcttcataaagaacagtctgaaatcaccacatggtagactcgcctgagacaatcaggccttattccaattacaagcacgttgaaatgctagagaaaatctaaccaccaccaacatccaccctgcccccaagaaagaatttacatacattacacacatggccaagaacaagagaaagaaaacagaaagccccaaggtccagagtcaaagaaagaaattcagttagcaagtgctagctgaatccacaggaacccatagggatttgggtcacaagtgcaagtcctaagcactgcgggtggggttccaaggcccaagcagggacaaaggacacagcttatgacccaagagaagcaggagagcaaagactggaacctttcctagcaaaagtagctgtgtgcctaaggctacgtgcagcaaaaacagtcatctgtgagaaataaaaaccacatttctgttacttgtatggtgtgttgcagcccagatagatgatagatagatgatagaaagatagatagataatagctagatagataaatgatagatagataatagataaataatagatagatagataggagataggtacgtaggtaaataggtagatgattgatagaagtaggtaggtagataggtaggtaggtactagatacatagatgattgataagtaggtcattagacagatgattgatagatgataaatgataaatgattgataaatgatagagagagagatgatagctaggtagataaatgattgatagaagataggtagataggtagatagatagataaatgattgatggaagacaggaaagtaggtaggtaagtagactgatgactgatagatagtagataggtagatagatgatacacagaagataggcagatagataattgatagaagataggtaggtagataggtgactgatagatgattagatgtatagatagatggttgatagaaagatgatagacagatagatagataaactgattcatgaccaactgattcaacacccctagggctctggcagaagcaaaaataaaactactttatagagacactttcatagcttacattatagagaattcacaaagaaagaacaatcctcactgaagataagctcacaagaaaattttgtaaagtacatgaagaaaaaaaccaaaataagtagattttagtagatgtagtagatacaaaaagattgaggattagcaccccaaacagcatggataaaagatcaaacaaaagcatctataaagttaatttaaaatgactttttaaaaacagaaatttaaaccataataaaaagcagcagagtataaatcaataacagacagagctgaaataactgaagacaaattccagaaataaaaatttaatagactatcttaaaattagttattcaaaaatggtaagagaaattactgaactacctagaaagaaggaaaaacagagatgttaaggagtgtggaggctagcatgagatgtccaagtgaacagtgaaaatgagggataaaaattattcagaagatatatttggagataaataataaccagattttagagaaagaaatgagacttcagatttttttttaaaaaaggagtcctgagcaaaataaacataattaaatccacatctagtcatatcatgataaaacatcaaagacaaagacaaagtattaaaagtgaccagagaatagaataaagattatctacaaaggaaacaacctgatggatacaagatttctcatcagcaacaacagacgccagaagggaataaaataatgccttcaaagtgctgctggaaaataactggcaacctaaaattctacgtcaggcaaaactaacattcaagagtgagtataaattgaagaaatgttgagggaaagaccaaaagattttactacttacagacacttaattaaagagctattagagtatatcttcaataagaagaaaattaaacccagaaaggaaaaaaatgaaattcaaaatacaaaggtaaacaggctgggcgtggtggctcacgcctgtaatcccagcgcctcctgaggcagtcggatcatgaggtcagaagatcgagaccatcctggccaacatggtgaaaccccgtctctactaaaaatacaaaaaattagccgggcatggtggcgggcacctgtagtcccagctactcctgagaggctgaggcaggagaatggcatgaacccgggaggctgagcttgcagtgagcccagattgcgctgcaccactgcactccagcctgggcgacagagccagactccgtctcaaaaaaaaaatacaaaggtaaacaaagacaattatgagtggatatatatgcatcttaaattcaattttaaaagaaaattatgagttgataaatcaagataagcattgatacaattaaagagataatagtaatgattaactttagaaatcattactaaaacaaagcagaactaaagaactaggtaacagtaacctgagagctggaagtaggggagcagagtcagagggccttggatcgtttggaaagtgggtagaaacaatgcttgatgtcagactttgttaggtgagggataattagacaatcgtaagaagagtctaaccagactaaaattagagtgtataacattcccaaaacaggagattgggataggcagcataaataaatttgataaagtcaggaaaaatgaaagtcacaaaataagttgacagtaacaactacaaatatattttgtatatattgtaatttacacaatatataaattaatctcacttgtcaaaacataaatattctcagcctggatgatttttaaaaatccagttatactctgtttatgagagatgtatctaaaccataaataaacagaaaagtttaacatacatttactgaaaaagatatacctgatataacataccaaaaaagaagttcagctatcaacaaaaagaaagctggaatagccactttactatcaggacaagttagactttaggataaaattatttattagggataaagatgagcaaagcttggtaataaggagcaataattcatcaagaagatataaaactccagaagctgtgggcaccaaacaacacagcctcaaaatacatatgcaaaaatcaacagaattataaacagaaatagaaaatccttcattatagagagaggttgtcgctctcacctaaacagctagattaagtagacaagcaattagtacaatgattctcagaggatgctttgtgagacttcacctgttgcctgacatttagtggccaggacctaaagctgagggtttggaggtgtctgggaccccacattctgaattgtctgaaagaaaagtcagacaatttctttcaccctctatgcaccccacatacaggggcaccagaaccagtggggtgggagcaaaggggtgggtacaaacaatggaacagacctcaccctccagattcccacagcccatcccccatgtcttgggaggcggtttagggaggaagaagggtagaatcacgtaagatcttccatgggttttaaaattgcatatatttattgaaagtatacaacaggatgttttgaaatactcatctggatatacatagacacagcacaatgattactacacagtgatactacagtcaaacagattaacatacccatcatctcccattgtcagtgtctttcttggggacaaggggatggtaaaagaacctacaatccatgtaagagattttattagaccagatcagacttttaagtgattaaaggagactggaaagctcttgaatctactccagacagtaacaagggatgtaaaagagagatctgtccaaacgtggatgaaggcaaaggggaagaaaatttgctgaatgcaccacttatacaaagatctgaaaacacaacaatccagctagatctagcaggcattaagggaacctgaaccaaactgaaaatacatactattttcacgcccatgtggaagatttctaaaaacgacatagtaaatcccaaagaaagtatccacaaatttcaaagaatgaagatccacacaacacgctccctcaccacaataactcgacactggaaaaaaacaaaggtatctcaaaaaaaaagacttaaacttaaaaaaataaaaacaattatgaggcaatcaaagaaaattatgaaagaactaaaccaccacaaaaatcagtacgtgaactcaatctacttgtattcatatggataatctcaacaacataaccttgaatgaaaaaaccacttgcaaaaggatatgtatagaataacaccatatgtgcaaaattataaacacatttatagaatacacatgtgtgcaggtgcacatgcatatgtgtgaaatctgtgctgtatacaggcaaagagaaagcagagtcacgtgaacaggaagaaaacacacccatttctggataccaaatggaagaggaagagactgggcaagaaaaggatcaaatgaatcatgcactctgtttgtaagctgtgtttcttcaaaaagactcagaagacaatacaaccaagcattagcgtgtgttgaatttggtcaaaggcgtttttcgttttattatgactggacttttgtatatttcaaataaatagaattaaaggagaaaagttacttaaatgctccaagccatttttaacacggcttctgctcctctgagcacctggctggtgcctttagagtggcgagagatgagaggccacaagggaaggatggagggagattcaggttcacaggttctttgcaatttaacatagcaacgctgcgatcactattcaaacacacagcaagtaatggatggcacttaatatgcacttcggtttcttccactgcccttgtgcaaagtaaggcttcccagaaaacaataagaactaaaatgttttcctgaaacaatgctagattcctaaaagcaatacccaagcttgagccataatgggttcaagggtggtggatgaaacacatcttcaaggttactgttagttcactgccatgcgggcttctatgcaaacggcaacattcaccatccaagaaagtaaagagcccagactcagtctccctcttccacagatcaactgggcccaaatccatccacttctctgcattcagctctttcattagtaaacctgatactagtagtccacgtgcgcgcacgcgcgtgtgtgtgtgtgtgtgtgtgtgtttagcaagaggggcttgaattcctcaaagtctcaatgaaaactcagtgtagactgaagcaggggagattgaactgcaattgtaccagtgcttaaagacaatgaatgtttgatctgagcaatcattctgtgctgtggtgtgagaaaggaaacctacggagtaatacccctccttcctgtgaccacatgggctggactgtgcatcttggccacctctaatgcaatgcaacaccaacccacgctgtgtctctctctgtccttggcgaggtcctacacacaatgcaaggaactgcttcaccgcactggccaaggacaacaagaataggcttgaggggagattgaaaaagaggaagaaagtgtttcacacagaggagaaaagaagttttagattaaaagagccctcatcacttcccatgtgctctcaccataactgccttggagggaagcaatccctgctatccacaaaccagcaggactggcagaaggtggaacacagaggtaatcccttccaggggctcagacccaacacaagggcttcacccttggctcacttcttctcctcgtgccacgcatccaaaccctatgcagaataacacgcatgccctcatcaccgcccacctccccacctccactgcaacgtccctggtccaggccactgtcacccctcaactggattattatgttagcttcccatgttccctgcttcaaaccttgaaactactgtccacaaggcaaccagcaagatctcccgaaaacatccatcagatcacatcactcccgctgctcacaacccgccaatgctgggcttcccatcacacagacccacggcccttagggaacctggcagcaccccttcatcacgtggcccctctttctgtgacctcatctccactcctcccctctctccatctggccgccctgacctccctgctgctcctcaagctcagaaggcaactggcaaggcaactggctgttccatgtgtctggaatgttcttccccagatagctcccggctcccccttcgcctcccacaggccctcactccagtgtcagtctttccatgactgtcactctataaaatcctaacccccaacactctccatttgctgcctctgcctcatttttctctccttagcatttatttccaccacagcaggcctttgctcatttgtcttattgtctgtctgtctcctgcctgaggatggggacattcatctgtttggctccccgctgcatcctcggcacccaggacaggggtgggcacggagtgggcaggcaataggtgtttgttaatggaattctaaaagtaaatgacaaaagagaagggaggtgaaggcagatctttgttttctggtttataaacttagtgctgggcaggaggaaaaaaagcggggggttcatgtgaagctcctttcctgagtcaacatggtgatttaaaataaactaaatttagttggagaccttttaaatcatttttctcaagtcagttatatgtgctctagctcataaataggaggaagaatgcgggtgacattcccaagactgcagcaaatgtcggccaagtgaaaaacacacagaatgtcctgaagatccagcgacgtcctgaatgtgacgcgttccagttcacaaaagaggagtcacaaaatgtttacaaacctttaccatcccattgaaatggaccttcacattttcctcaaaaatagctttctaaaactgttactggtttacattaattttacctttcttctttttttcccctttttctttcttattttagaaataaagtaataggattagctttttgattaaagcatattaataaaattttgacattttatttgatttcaaaacatgttccagtttccatcattatagtgggtcctgtatgccatgtttatgttttgaaaggctgaaattatgtgtgatcaacaaatttattttatatcaagagcatctgtacatattaaatcctaaatgtgtcttgaaaaataccccctcacctttctctatcctgcattttatctgaagcattgtaagtcttcatgaaaaacagaggaaaaaatgaaacacagtaactaactaggaaccattagaattattttctttgacatttcctttttttttttttttttggagacagagtctcgctctgtcacgcaggctggagtgcagtggtgcaatctcggctcactgcaacctccgcctcctgggttcaggcgattctcctgcctcagcctcccaagtagctgggactacaggcgcctgccaccatgcctggctaattttgtatttttagtagagatggggtttcaccgtgttagccagaatggtctcgatctcctgacctcgtgatccacccaccttggcctcccaaagtgctgggattacaggcacaagccaccatgcccggccctttctttgacatttctaagcagtagatatttgcaaaccatgttaacgatctgtagatgtatattactaacaggcggggcccattgaaatcctaactcttctccatttgtttgctgattcttatcagtttaaataaaatgttcactcttaaactacattttaagcaccgcataggaagaaggtgttcatctgaggaagcagtgaacggacatcataaacttagtcaagactgtttagtaaaatcacaaatagaccaagcagtttcactgctgtgagtttaaaaaaagaaatcactgatctttagtcagacatagttttctgaacgaaagttagcacacgcggcccctttccagtctacagttgacatgtgtcttctaagtgactagactatgaaacctctaacactctcatcagagttaattcagagctagtcactaaagcacgccccctgaccacatcgtaactactgtgaaaagcagtccttatagaaatcatgacgttcttttcctttgtttgcagtaggttgttcatcgttttcatgagaacataagggccctctcccaaatagctcagtccccaaaatgcagacatcagcaaatgacagcaggtaacgcctgcagactggtgctcgccgctcactgtgaaggcaagcaggcttctgcctcagttttttccccctttctcctctgatccattccaatcaacaccactgacagtggacagactgctgtccgggtaagagtgagggggacagagggcctgaagttgctccattcgtcctcatcacgatgggtaaagaagggacttcatgtccatgtgcagttagcttccaaaagacaaggaaatctcccacctagaaggggacccccccaataccaaccacaggctgggccccccctcttcagccggcccctgcccaggtcctgctgaccaagcctcctcaggacacaaggtcagttcaggacttcagtggcctcatcccttgcatcccaccttctgagttaaagtctttcagaaatacagcaccatgggcttctagagctgcatggaaccctggagatcatcccactccactcgttgaacagtgggggaagccaaggttcagcaaacgggattcttccctcaggcttcatatgcaatggaagggcaccagctaaaagctaagcgctttgactcagagccaaagaccagggacctttctagcaccttcctcctacatataacttatatgtaggagaaacagttgtttccatgagcccatagaagaaatgtgatgtcaaagtatgggagaacgttggatagcattaatgtctagtcaatacacattctccccttgttcttacaatgaatcccaatgttgttcagggccacaatatcttcaggtacaaattacattcccaggcttccttataagatgtggccatgagagggagttgtggcctaggagatgtatgtagacatctactctgggtttctgggaaatcctgccctgctcttcctcttagggacaccctcctacctcttccatccttgggaccacgcagatgaaaccacctgcaaagttggcaggcagtggctagaaggcgactgggatggatgaatggcttccttgagcagccaccctgggaccatgcagatgaaactacctgcaaaggtggcaggcagtggctagaaggggactgggttggggacgaacggcttccttgagccctggactggtccatgattgctcaagtccaggtctctccttaggcaagacaaacacacatgtggggaggaaggccaatttatctgatcggtgagttgggaagaaaagacacagcatggtcagcgtggcctcagcagggagtccctcctttggggaaatatcctgtcccaaggccaaggtattattctggttggccattggatgagattcctgggacaggctctccctctgggggaagcccaagattgtccggctctactcagcacaaatgtgtaagtgtgtatcagaggtgaagtatcagaagtcttaggtatttaattattattaaggcaaagattacatcactgcctgagatacccaaatcccatcccaagcaatttcctaacaactgatctcataataataacaatcttattatgaaaaggccagtgcaaattgattcttagagacactattattcagtacaacaagaatcagaaagtcaccataaaaccatggatgtccagttaattcctcaccttactaaagcaaataaactgcctttagaattaaactggcaataccagtgctgccctcaaaactcactgctgcctcaccaatagataaaatgtcacatgagatgatataaaataaatggggagatgcggaattacctcactgaataaaatggttatctgaacaaaatgtcatgtgaactgacttgtcatggagcctaaaatttcttgagtcccattcccttaggtgaaggtgggaaggcatctcaaaaaatgcaagcatggggctttgaaaaagtcttcaagtaaaggaggcagtaaagcaaaaagggtagaatcatgagctttcttcagttcagagttagttctggttctggctctgacatgtactagttttgtgacctttttctaattagtagacaccatctcagaggtagctataaagattttgagatgaagtctgtaaagcatctagtatgtagaagcatagaataaatgatagctgacaattattagagtgattattatttagagtgtctggcagtggtgtgctgacaaaagggtttttgaaaaatcatttgtttggggaggaagccctggtttgtactgactgccaatttccatggtgtgaacacttccattacagtcaacttcaagctaccaatgggatgtcactgaatgcagagttgagaagagatgcatacagtcagctctcaggagctgccaagagtcagcaacagcttctctctggttcaggcactgtagtcacacctattgacatggtttggttctgtgtccccacccaaatctcatctcaatttgtaatccccacgtgtcaagggagggacctgtaaaccccacgtgtcaagaaagggaggtgattagatcatgggggcagttcccccatgctgttctcatgatagtaagttctcatgagatcagatgattttatatgtttgacagttcctccttcacacactctcctctctcctgccgccttgtgaagaaggtgcctgcttccccttccaccatgattgtaagtttcctgaggcctccccagccatgcatagctgtgagtcaattaaacctctttcctttataaattacacagtcttgggtatttctttataggagcatgagaatggactaatatacccgtcttgatcattgggattcctctgtgtacggcaaagcacctagtgaatgaatgatttatgaatgatgggttattattaacacacaaagctatttttgtctcaataattttgcatacctttgaactgagactcagaaaaaaatgttttcatgaataagaatagataagagggacattagagcatggactgttgcttatacttgaccatgaacaccgagacagtgccttcccaacacctagcactattccaggtataagatatatggcctgtaaatgacttctggtttggactggactggactgaactggactggactggattggattggattggacaaggatgcagaaagaaactgaccataagtctgctcagaaaacattcaacctctaagagggagggaagtctaccctcccccacctcatttttatcctaagcactgcctggaggaaatgccctccaagtcccatggtggaaaccatctaagatgccccttcgtccatggggcttgctctttattttaaatacagttcagttttgattgctgaaattttcttggagccaagggattccaacaatgctactactcagaacatcaagaaattccctggagattcccaaagtaaataatgtgatataactcttacctacaattaatctatgcatgaaaatatattgagggatatgacatcttctaaaattacctgcctgaatttctagcagagagacctagggagttacatcatatgctgcctctccaaacccaacctctgaatgacctccacgaagggataacataataatgcggctgtgtcttggtaaatgtcatttattccctcatgaattttgacagagatgacatcaagtttcttccaattctaagatttgatggcaccataaatatgacttcaatttttaacaatttaatgaaaaaatccttctggaaagagctgctcatggggaaacacacctcaggcatgaggcacattttcttttccagcccttcctccaaccataacagatccaaaatggacttccaggaggatcctgaaatgagcccatgtgttcagcctctcccttaaccacatggaaagggcaggcggatgacctgcccaaggttgggaattcttcacacactaaagtccatcactgacatttaggagaacattttgtttaataaatgcaaaatgttctttaaaattatatccatgctttcattgtcaagggtcttaatggatgtgtttaaagcataaataaatatagtaggcattctgcttgcttaacctttcttcctcaccccttcatctcttcatataacattcactgaacataaaacaggacaagtcctgaactcatttctattccaagtactaactcaagtcactggaaaggtttctatttcatttagatggtacagagatgtcctgctgtttctgtaccatccccatcccattgttgatatttgatatgtcatgttcatatctgttgtctttgtttcccaaagggtttgtttagagtccactgctgaagaagaactaaatggaatctgtctctgggcaggaaggtagggaaggcctttgttttcccccacagtggcaccgacccagacaacagatgacagaaggaagagaccacaggcaggacaaggccagcctggagcagcacctggcaggacgaggcttaaaagaatgaataaggggtaggcccaagcccacacgtgtcatggagtaccatttacaactttgcccacttgacaatgggaatggggagagcagagccttccagaccatcaacagtaggatcagaaagtagaagagtctggaaaagcaagactaagccagaataatctggaagaatgcagccccagtgagaagttgacagccaagcaaggagcaagaccatcctgttaagaggcactgagtggtgaaaacagccttgtcatgaaacagggcagatgatcatctcggaacgaacaggtgcattcaggaaagataaaaatgaaaacaggaagatcaggatcattaaccggtaaaacaatgcatgcccctaaaataacaactgacaaggataaagtggcacagagtgagaatcacaaagtaacgtggagcagattgactctaatagaccttttctggccccaaaagcaaaaggtttggttggtgacatcttaagacaccttaactataaggtccctaagtggacaagagcaggcaagctctctcatttggcggggaggttgggggggaacaactttaaaacagaacttaacaaaatggctaatactaactccttgagaataggattcttctagagaaaggcaatggtttgtaggtaatgtagccattctgtcaatagcatcagcaacagcactgcctcctttacaacacagacctctcagcatcaccctctgtggggcaggagacagagtgagcagaggttagtcacatccatgtgggttctagctcccctctaccactcactagcagtgtgacattgctcaagtgacaactttgtgcctctgtttcatcaactatcaaatgagaataaaattagacttacccaccagggttgctaggaaaactaagcgttaaagggcagaacccaatcctgaaaatttagcaagtactcaataagtcaaagttagtccctggataaggacctgaaacatgaagtagatgcaattcaaccagggtcatgcaaagccgggttcagtgggaagaccactgagtctgtcagacacctcacattaagccaacagtcattgtgacctaccaccatccacttccctgacttctccaagatggtgtcaatgacacactctacctgtagaccgacttccttccccatgctccagccagtccagatactaagctgaatgtacttcagagcttcagcttcataagtcaatggagtctagaattacagcccacacacctggtatccagagagccagagaagagccttgggcacatatttctccaagacatgggatgtgtttctctgagacatttcctcatcctcctcctctctattcctcttgctccctcccctcatcctcctcctctctattcctcttactccctcccctgtctcttccctcctgctcccccatttaatctcactgtgatcctagcctgcttcactctctggccttgcagctaattaaaactgtggcccttagtcatttatttaaagaccccaaaaaaatggcacaggagatctagcaatcataaaagcatcacttttctgagattctaacagggatagctcaggaggccctacacaatgtattggtgaatctattctatttcagcctaccttgcctgacactgtttatagggccagaatttattaccagccttacggcttcataaattagctagtcagctattgccacacctcagtatactgtcacatctgtgaatttatggcattgtggcttaatgtagcatcattgtcatcactttccagtacctggagcattcattttatcctggaagataattcgtcatggttattatgagaataccaacataaacaaaagaggaagaaaacatgtaggttatggtctaattgcctgaatcaatcccagaagaaaagaagatacttgacaaagtctgcagtctttgaatgaatcttgaatgtgcttagtattattcagactcgaaatgctttgcacacttgaatgggaaagtatgcagtgaaaatcccattgaaacgccacagaacgccagccaagctaaagtgctgcacttggttggaatatctgggctctgactcctccgtaaatcaacatttaaagtgttagatacagagagtccataaatcattattgcatttcttcagcataagctagtgccttcagcaagtgtcttctgctgtttggctctttgttctgatctggtttgatatggctggtgtgggtttggtttggttcgtttgtggggatgaagaggttatgcaacagaaaggcgatgacttattcttttgctcttgctcacatctcccaggacgtaaaaacaatgccaattcaaccctcctactcatgtatgacggccaaacctgacttctggcttctaactgcaaaatccccagcacactctgcaggcccgcagccagctcgtctgcttaggaaggagcaatagtgtaatttgaacatgaccaataaaaaagaacaatggtcttacttacttttacaggttacattgtctcacaggtaaggaatggaatttttaatacatttaaaaatagagattcctaaccaataaaatatccccatcaccaagattttaaggatgccatgagtagctggtattatcaatgacatttgtgtagtgggaaaagcatggattttggagaaagaaagatgcaggcctaaacgtggactctatcattcactattgcccaaggacaggctttctctccaccaggctaaatcaagtttcccagtacacaagtgtggtggggagcagagtggttccgcagcagcaggctggtaaatttagtcctaaaacaagacaggtctaaaaatcttggaaagtagaatctgtttggaagctccttctagacattctgtcaagcacagccttgttcagtaagaaggaccttagacatactttactcatggcttcccagaaaaaaagtgaaggatgatgccatcagttttcagcatttattgagagaactcgaactactggaggatttcaaagatgcttattgggtatccaagtaagacgtcaagtaaaattttggatacaggaatttgagtgtgaagggaagcccaggaatgcaactatctgggagtcatcggtgtaggtgggattggaagccatgggatgggatgagatcacttaggaagcaacagactacccccttctgtgataaataaattccagcagattagtgtagattattgtccccaactcttatgtcctacctcctttcatgcagctccacatgtcatcttgtgacttgtgcttgcctggcagtagagagcgcactttcctctccaggaaccttgggcttggccaggtgtcttgctttgaccagtaaaagtgagcaaaagtgaaagtgtgtccgttccaggtggcaacttgaagaggaatcatgcatttctgcttgccccttgccatctccccgctgccatgagagcagcatgcctcagagagctgctgtcccttcaacctgggacccagaataaaagacacagggacctccattaggcccagctgagtccgacagagctccagggacctgaagtcctctgagtgacaaacaagtggttgctgttacaaattactgagacttttggaggccatcatttgctactgcagcaaaagctgactaatacaaaaataaaacccatctcttctggcagatccccccagaaaggagggttagtctccctcatagatatcaggccaccaagcctaagagagttccagatggctatgcaagttcagcccaaggcaatatacaaaaatgctccgagtttaccactggaatttccagagtctacttagatgctcccctgagtccccactcatgcctttccagcaatgaaaacctgctccgaagaaaaaatggctgacatcgagatgactctgagtacacaaggtgcgaagttacaggagacagaggctctctcggatctccaggtaaacacacgcagctgctcaggaaggcagcctgatccaggagcctgcaggagcctgagtcctacccagatggtcaggtgcagccccagctgtcccaggacatgcacgggaggaaaggtgaccacgtgctgtcagatagcagctcaggcaccactgtgcagtgcacaaccacacaggccttcattcagcaggggactagatttgtactctttttagccaaatgtgggccttctcatgctccacgtgtaaacgtaactcaccaaacagggcccctgctgctttccgggccaagtcagtggagaggactgaaggccggctcacagctaggaaagcagggctctgccgcgccgagggaatgggtcccaggtctctttcaacatcagtaggtaacacacacactcacagcacacaccacacaccacacacactacatgctcatacatatcacacacacacacacaccccccacacatgacatacacaccacaccatacacatacatgccacacacacatgctcatacataccacacacaccacacacacaccacacatcacatacacaccataccacgcacatacacaccacgcacacatgctcatatgtaccacacacaccacacacaatcacacacacacgtcacatacacaccatatcacacacatacacatcacacgtcacatacacaccacacattacatacacaccataccacacacatacacaccacacacaccacatgctcataaataccacaccacacacaccacatgctcatacataccacacacaccacacacacatcacatacacaccataccacaaacacacacaatcacatatacaccacacatacacaccatgtgctcatacattccacacacccacaccacacatactacatgatcatatataccacacacaccatacatacaccacatgctcagccataccacaccacacacacacacacacacacacatcagcacacacacacgtcacacacattttacatacacaccacacacacacaaagcatgcacacaccacacacaccacatacacacaagaccacacacacacatcatacataaaccccacatacacaccacacacattatatatgcaccatacactcacacgcacatcatgcacacacaccacacacatcacatatacatgccacacacacacacattacatacacactaaatacacaccacatgctcataaataacacacatcacacacacacagacaccatgcatacacaccacagagcacacacataacccacacacatcacatactcaacactccacccacacaccacacaccacatacgcaccacacacacacacacacacacactgcacacacaatacacatacacataaaatttgcatgaaataaacataaaggaaatgaacaccaagattcatctctcttgccctgcatattggattgaaacatggagcagactggccaaatttaagatttttataatttacctctgaaatcttcatcaaattcaaaacacaatttcactttttgccccatccggcagtgttgggggttttgccactggaataacacagtatattttccagtcacaccgtacatcagagctcatgtgtgtgttagtttgttgcaggcgtcctggtagcagagcgtgaggtcctagactcagagtgagttcctccctccagaaatgaaacacctaagttgctcagcactgacagcaaacatgtaagtaaggcaaaggttgccaccagcccagcaggggtcgaacttaaaatgaatctgtgcatgtgggccccttgcctttgacccatggggagcatcattccataaataaacaaggcaatacctaacagccattagatttcttcaaggccatctctgcaatttctttgatgaaacaaaattgaagttcataatttcctcccaagctaatgttttacaataatttttttaaagatcccagagttacagtaatcacatatcaaataagaacattcctgagatgttttccatttggaatagtgaaattatttattaaagcatctcggccttcatccttcaggctatatgtgaagccttcaagaaaacctcctcgtgagcctaaccacatgacttggcagcccccactcctactttctagatcatccctggccatgctccaccacccatcccatgatccagcctcggcaaagccctggctgtctccacattacaccaagcacctggctgcatgctctggcatacgccacttaaactctcctccctgggaacatcacatactggggcctgtcgggggtgggtgggggacaaggggagggagagcattaggacaaatacctaatgcatgcagggcttaaaaccgagatgacggggtgataggtacagcaaaccaccatggcacatgtatacctatgtaacaaacctgcacattctgcacatgcatcccagaacttaaagtaaaacaaaaaataaaaaaactctcctccctactcatcccggcgaactcctgcctgccccttagacacagttcatgcaccagctctgctgggagacaccccttctgtggtctccatagagctcctgtccacctccgttcacagcgtagggctgggaaaaaggttctgtgatgggacgacctggatttgaatctcagcaccgctcactggctatatgaccttggacacttaaccttcctgtatctcaatgttcttgtctgtaaaactgggataatataagcactcacttgaggcaaatgtggtagggaatagatattttaataaatgtaaagcacctagaataatacttgaaacatcacagcccttatcacaatgtattaaagttttctgtttatgtggctatctcccccactagactataagcattttaaaaagaatatgccttattattttaatatccccagtatttagcaaataacctggcacatagaaaattttttgttcagaatgttgaatgaatgaataaatgtatgaaattaaaaatatatattaatattaaattcctgctatcctgtcccaaaagacaatgtgctgtcatcactgcttgaggaagaagtacattatttcacacatcaacccaccttcatcctttgagaatttttttttagagcagaaatagactctatccaaaccatatggcataaagctgtagtttttaaagataaaggtacacttcaaaaaagtgctgactcatttcatccttagatacagaatactcatcttcagcattacaggcttgtgatggaagaatacaaaattttaaaaatatataaattcacctcttagaggtaaaggtttgaagaacagagttatttggtctacttgcaccattagtttgtttttttttaattttactttaaattttgggatacatgtgcagaacacgcaggtttgttaaacaggtattcattgtaccattagtttttaagaatccttgatctttaaaatgctacccacttggcctcctcttttattcatggccttgttctccaggagagaggctgaaacatcccttagggaacattttctgtcaaggtgctagaccaggagtgtgaagcagcgagccttaaattgcaggaagccacaacagcagaaggcagaacgctcctcaaacttgaacgcagagcctggtgctgcttccaggaagtcccaagccagcctgacttctgacagttgatctcaagatctcaacctatattcattttcacatcaagactttatttttgaacaggttccaggatacaacaccagcttttttattgaaggcaaagcattctcaattacttagatacttactaattaatatgattggcgatatggtgcgtatttagaataatctgagatgaaactcattgaagcagctttaaaaagcccattacaataaaaataatacttgaagctctttttttttttttttttttttttttgagaccaagcctcactctgttgcccaggctggagtgcagtggcgtgatctcggctcactacaacctctgcctcccagttcaagcgattctcctgcctcaaactcctgagtagctgggcctacaggcgcctgctaccatttccagctaatttttgtatttttagtagagacagggtttcactatgttggccaggctggtctcaaactcctgacctcaggtgatccagtcaccttggtctcccaaagtgctgggattacaggcgtgagccacgtttggccaacactcacttttcccaaaatgtcatgataataatattcagtgtggaaggactgaattctgagtcacctgcaaaccatgatacagtctgtagcagtggtactgagtgtaatccatagaccagtgccattttgcaaaatgttgactgaccatgatgagagaagtacggaaagtaagaagggcttgtaaaattttagagcaagttgacatcactgtgacatcagtatgagctcagtgctccagttcctctaaataaggtgccgaccacttcagacactgcagcattactcacatttgggcactcattggtagggccacattacaacatgtgaccttttaaggtcagtttgtcaaggataaatcaaattatatgaaaatctgagaaaagggaagcacttattttcataacttattttcataatctgagaaaagggaagcacgttatgaaaataattaaaatttaattaattaaatgtttatggctttttaaaatttatagtttaacattactggctaaataagggaagtcaaattagtattatgtatttataacctttattgattgattgatggcctctttttggtcagaaaaacatatatcttttttgaatgtgacaatcacagtaaccaaatgatgacaaagaagttgacattgaagaaatgaaagccaaaaaattttgtattcattttacttgaaagtataatccctcatatacaaatttttatagtttatgtagccataaactacagttttgcagccataattgatagcaaagtgctaaaaacactgtaggtcacttgaacaaatgtattggcaaacaaaacaatgaaactatcaaaacttgagtagcatttacataaaaaaattttttaaataccgagaataaaaaaaaatttgcaaaaaagagtattattaaaaagacaacaaaagtagatgttgaatatttcatgtctaaaaatgaatgtcttaaggcttcctgtaaagcagcacttacattactaaaaccaaaaacaaacaaaatgaacaatcaaacaaaaatcataaaattgccaagacattaatgtaaaactacattaaagaagtctacttggaaatgttcggtgaatctgtaacccaaaaaaaggaagcttgagtaccactttttaataatatcacaaatcagtgtttttaagaatgggctgatagcatagctgtaatgacaggaaaatactgtgaaatcattattcagataacaatgaaaataaatcaacaacctgcttcttttcttcagaaagtcttgccaggaggaaaaaaaaaatcagctgaacaacatgcttagagacatagtatataaaaactaatgcattaaattcaaggtttttacatttattatgtgatattatagaagatgaacataaagaaccgtagaagcatgcaaggcttgatggctgttatggggaaagattctgacaagaatgtttgaaatgggaaatgaactcttagcgttctggtaggaaacgagttttgtcccatgtttttaaagatgtgaattagacagccagactttcttatctgtctgacatcctcagtatttgaaaatatcttaatactcctatgcaagaaagggatgtggtaattttttgatgtatatctttatataaccatgcatagaagagtctgggaatatacaaaacaaaataataagagtggctaactctggagagaaatgacaaggagttttctcttcttttttttttttttgtgaaacagggttttgctctgtcatccaggttggagtctggagtgcagtggtgtgatcttggctcactgcagccccaacctcctgggctcatgcacacctcccacctcagcctcctgagtagctggggctacaggtgcatgccaccacagctggctaattgttgtatatttttgtagagacagggttttgcgatgttgcccaggctagtctcaaattcctgagctcacagaatccactcgcctcagcctctcagagtgctggaatcagaggtgtgagccaccatacacagcctgctttttctttcttttgcttctctgtatttatagttgtttttctaccctgaatgctgcctatgtcattagaaacaaagaccacagagtcataaaagggtcacacaagttcaaccatttaaaaaacattgtcaagagctttgcccatctaagggaccacatgagcattaatgactgatgggctccatacactacccagaatgactaacacatcaatgaaagacatgatgatctaaggaccgagggaggggtcgatctaaaacacaaaatgtccctgctcaatagccacctgcacacccacagctactgcgtggagaaaagagagagctggctgcagtccccctcctgggggaaactgtgaagcacaacagagacctgctgtctggaacctggtggctccctccccacagtgagcataccacacctgcactctcatgcccccacttctctcatggaacttccctgtcccttccctccagaagctacaagctctcagaatcacacctttcgtgctccagagtcaacaaggctgagtttgtggtgggcaacaaacagactaaatcttcacaccatttctcattaaaccatccctgttcatgagatctgcattaaaacttttttctcttttgtcaagagataaagcagcagtacacagctttagaggactagggcctccccagtaaccctttcctccaaacctttctaaacaaattatcattatcattggtgccgttatcagtatactagtactgttaaagccaagagatgacctgttttaggcaataacatttacaattcaatagcagagtttcctgcacagactgtactatttacagagtcctgcagcccctggacaagggaacacaggctcccagctgcctgcttgcagagttcccctgtgggaggcagtgagatggaaacacctggatgagaggccaggagacataagctcctccatccctggttctttctccagggaagtaaactaaggcagattgcccattctctctgctcctaaaccagaggcaattttaagtggcttccagcattgatacactaggtctctatgaaaggtgcaaacctttccacactcaatggattctcatcacaaccaaagcagcagggcagtgtattagttaaaatccattttagttgcaagtgacagaagataacattgattttttaaaaacaatggtggcttaaaaacaaacaacccaactcaaaaatgggcaaaggacatgaacagacatttctccaaagaccattctatggccaatgagcacatagaaaaatactcaacatcaatgagataccacttcacactcatgaggatggccagtagaaaaaaaatatatcaagtgttgttgaggatatggagaaattggaacccttgttccatgctggtgggagcatgaaatagtacagctgctgtggaaaacagtatgacagttcttaaaagattaaatatagaattaccatgtgatccagcaattatacttctgggtatatacacaaaagaatcaaaagcaggaattcacacagatacttgtacatcaatgttcataacagtattaatcacaataaacaaaatgtggaaacaacctattcatgatcaacagatgaacaggtaaacaaaatgtagtctatacatacacgggcatattactcagccttaaaaaagaaatgaaattataatccatgttacaaaatggatggcccttgaaaacattatgcaaagtgaagtaagtcagtcacaaaagaacaaatatcatatgactccacttacatgagctacctagattaggtaagttcacagggacagaaaggagaatccaggttaccaggggctatggaaagggggaagggggaattagtgttcaacaggtaaagagttttttgggggatgatgatttttaaagttctggaaatgatgtggtgatgcttgtacaatattgcaaatgtgctcgatacccctgaattatattcttaaaaatagataaatgataaaatttatattatgtatgttttaccacagtagatttcttgttaataatggtggcttaaaccataggaaaacaagcagataggcctggtatgattatcagggacccaggttccatccattcagccacctcaacacagggcttcctctttatgatccaacatggctgctccaactccagtcatcatctcagccatgcaacagggaggtgggaggaggaaggacaagggcactcctctacctggaagttcaaccttcccttgagggatactttctggaagtggcacacagtccttccattctattggtcagaacttggtcacatagttgcacatggcttcaagggaagctgggcaatgttgactttgttctgggcacccatcttttcagctaacattgaggaagaagagacaaacaagtactgaaaacaacaaccaatcctgcataagttgaaaatcaccttgagtgcaaatgttttttagcacaggactgcacacctttatgttttcctaggatcacagtcaaaaagaagaagctttaagaaatggttctgaggactttcttctttgttaagctcactttgcaacataagaggaattcagacctcatagggatgtgagctacatagttattcaccatataccctcaggaagaagtagagctaaactgagaagcactacaaagaaaaaataaatgaagaagaacaaaaatgaagataaagggtcactttcttaatgcctcatcctatgcattttgtagaatttgaaacccctggaatggaaagcataaagctctgacaatctgggctgcattcagccttggcagaaaccaggatgtgaccactggctcattcctaatgtttcaggtgggtaacaaatatttgctttttccggggagttgaccacacaccctcttccaattccttcaactcggactgcatcttgcccttgagaaaaaagatttggcaccttcagaacacaccattccccacacttcatttcccattaaggttgtcttggttaaaaatgttgcgggccaagtacatggtttcacatactcacatggttaagagagagaataggagttctatgagtcacagaaaatttggttgaaaaaaaaaggaatcaggaagaatcagtaacactaaacgcccacacgtctcgtctctttaaagcacattgggggaaattttgcttttagtggtaactgaacattctgttgctgctatatatgtcattttcagcagagatgaaataactaacagcctgggaagatttttatagccttcccgtcctttaagggatggcgtggtcccaattttgacctcccttttactactttcctttcctttggataaaatccatgtaatcctctgtaacactagaacatctctgcattactgtgtgcacacctgatttccgtaccgttttcacccctcattttggcagcaatctatgcataaaggcaaaaagttcccacacccctatcctgacctcttggtagccgtgaccctcatcccagctcaaccctcctggcatctcctctctcctgccaggtttgtggctcaagtcaggaagcacgtcagccctgagacctgcaaaccgaatcccacagacagttctagagggtgtgcttgactttggaaacccagtttaactggcttctgcttgaatcatcactccattaacatcatcattccagaaagtcgttgctcaaggtctaaagcacttgaaaccttcccttatatttaatatttattacccatcttgaaggaacggcatctgaggacatcctcccatcttgtaacatggctcccctaagaagggtataacatagtgattgcaaagcaggactctgtagccaaccatccagatgcaaattctgattccatcacttcgcctgaatataactttggataagctgactaacctttctttgcctctacattcttatctataaaatgggcacagtaaaagtgcatcctcattaaaaaaatggtctacaagcatatgaaaagatgctcaatgtcactaatcatcagaaaaatgcagattgaaaacacaaagagatgtcacctcacacccattaggatgaacactataattttttaaaaattaaaaacaagtgttggtcaggatgtagaggaggtagaacccttatgcactgttgatgggtgatagggtttggatctgtgtctccacccaagtctcaccttgaattgtaataatccccacgtgttgtggagggacccagtgggaggtaattgaatcatgagagcaggtctttcctgtgttgttctcgtgatagtgaataagtctcacgagatttgatagttttataaaggggagttcccctgcacatgctctctctctctcgcctgctgccatgtaagatgtgactttcctcctcctttgccttccaccatgattgtgaggcctccccagccatgtggaaccatgagtcaattaaacctctttcctttataaattacccagtcttgagtatgtctttattggcagcataaaaacagactaatacagtgggattgtaaaatggtgtagcccctctggaaaacagtatggagggtcctcaaaaattaaaaccagaaatgctgtgtggtccagaaatcccacttccgtgtccatatatccaaactaactgagatagatatttgcatacccacattcttggaaggactaatcacaatagccaagaagtagaagcaacccaaatgtccatggatggatgaataaatgaaatttagaatatacataccatggaatattattcagccttaaaaagtaagaaagtcctgtcccatgttacaacatgaatgaaccttgaggacattaagctaagaaataagccagccacaaaaaaaagataaatatggtatgattctagttatataatgtatctaagggagtgaaattcatggaaacagaaaatagaatgggttaccacaggctggagaaagtagggagaggggagttattgtttgctgagtgtagagtttcagatttgcaagatggaaaatttcttcagttttgtttcagaacaatgtgaaaatacttaacactactgaactctacacttaaatatgattaagatggtaactttcatgttatgcatttctttttaccataatagaaaaaaaatcatttaaaaagtgattcttcatagagcttttgtatggattatatcagttcatgtgtgtaaagcatacaacactggatggcacgagcgagcatttctcaaatgtcatcgttatcaacgaattcacataccctgctccatgctatatcagcacacatgaattattttatgtttggttgggtgcctttttatttgtttgtatggagttttgttttcttatttatttttgccttctcaattttctgtgttttctgaggcctgttttagaagctttacacatctattttttaattattccttaccaggatgaaaataaaaagtagaaaataaatgtctgagaaaaccatcatctgcatctccttcaatttcataagatacaatttgaagtgccgaattatttcatttgttttgggttttaaaggtccttctttttactgaatgagagggatgtagattggcagcagttgatatgaaaaaaaaaaaaatcaggttgtttccaaaggcagtgtgatgggctgccctaaagctgctgcctcaaaagaaccataaggttcagatcacaaaatataatggtctcagatttcctagggcctgttctgtatataattctctaagaagaacattgataaaaaataatacgtccacaaaaataaaaccaatatgataactctaaaatacatattgtaggaaatcaggttaaaataagtagttgtattttatctgcaaaagagaagtttaaggaaatactgctttgaaataaatgaagataagtcaaatattcattcatttattcagttctgaaattattcagccactattcactgtaagatttctaggtaccattctaggtgttcctagtccccattatgagcaaaagtcgccacttcactgtgttattcgaggagggaaaagtagatacgatgatggaggcatatttgaggtcgatatgagaaagttcacgctcacaaacacagctgtgcataacgggaatggctattttatgagggagtaagttccctgtccctgggaatatgcaggaggagaaaatgtgagcattaagaatgccaagaagaaacttctaactagaccccaaatatctggtgtagataacaatcaacctctcctccaaccaaaaactcttcgagtccagttttaaggcacatcaagtggagagaacatctgtattctcagggtgacttcaggacagaatgctaagaaaatcttcactactgacttccatgttgcctgcacgaagacccaatattccattgtttttaacacagacctataatgaatctgtaacacttattctattaaaaatagtcagctccctttgcatggatgcagattgatgatccatttttagaatctcaataatgattacaatggcacagcatgtcacctggaaggtatactgtagaatccttgcctacagggtttcactgaagctttgaaaagaacatgaagataactgctaaaacttggaagcaaccaaggttccttatataggtgaatggataaacaaagtgtggcacatcaagacaatggaatattatttagcaatgaaaggaaatgagccgccaaaccacgaaaaaacacggaggaatcctgagtgcatattgctaagggaaaagtcaatatgaaaagcctacatactatatgactccaactacatgatattctagaaaaggagacagtaaaaagatcagtggtttctatgggttagtgaggaggaagagaaggatgaatagggagagcccggggcatttttagggcagtgaaacttttccatatggtactatcatagtaggatctgtttttaacatagacccatactgaatcctttctgaaaaatgtgagcctactataatagtatagcctactgtaatagtaggctcacatttgtcaaaacccataaaacatacaacaccaagagcaggccctaatgtaaactatagactttaggtgataatgatgtgccaacctagatttatcaattgtaacaaatataacacactaaaaagcaaaaacaatcaaactactctgagataccaaaaaacaccagatatatgcataaataaagaaatagtgagtaattcgataaatgaaaaagtaaccaagaggaaacttcacaggcatgattcctttaaggaaacaaagaaataagcataataataataaacttctcatttctaaaatccaaaaactgttacaaaaggattcaatgtgatatttttaaagcacaattattgagcataaaatacaatctggaaggcatataactttgcaataaccttttctgtgtttaggtaaggttgactgcagagttgagagctgggccattgacatttgaggtcatggtggcagcagtccgccactattaccacctatgtccaaacatagctgaccctagcatgactcaggttgaataatattcaggaaatgaggccttgggctagggtcccagctcttgcaatcactagttccacaatttgggggaggtgattcttctaggtctctattttcccatacaagatgatatggtttggctgtgtccccatccaaatctcatattgaattgtagttcccataatctccatgtgtcatgggagggaccagggcaggtaactgaatcatgggggtggtaccctcttgctgttctcaagatagtgagtgagttctcatgagatctaatgattttatctggggcttttccccctattgatcagcatttctccttcctgctgccatgtgaagaaggacatgtttgcttccccttctgccatgattgaaagtttcctgaggcctccccagccatgttggaactgtgagtcaattaaacgtctttccttcataaattacccattctcagttatgtacttataggagcctaagaatgaactaatacacaataaatgcacagaagaggtcagctagcagttttcacacccgtctccaggagaagagaagctaggaggagcaggagggcaaggagggtccggctcccaccaaaagagttcaccctctgggggaagggctacttattgggcttttatgcaaaattttatttgaacaaagaattcctcagctttaaaaatagtggcatctggttccttttccctgaaggtatttactcaagccaaggaatgaagcacctgtgggtgaagagcagatgaaagctggaactataaaagccggagggaagctttttctcatttctaaggagattatcaggaagaatgtactctggcccctggaaacccatccaacctctcctctcccacctgggctggctgcagcagctctgcaggatgtcacccaaaaagctccgttcccaaccctgcggcccacagcctgacaggaaaaagaactctctcaacctggattccggggccctgtactctaatagagggctggacactgcctggctgtccccctgcttagaaggaagcaaatgtttattcaaaaatatttattaggtaatacaacaaactgtcaaaaaggaagaggcgaacactgttacagtttacaaacatgaaccatggattcttaacaaatgggagactttaaatggggatggaaataaagccccaaggaggggaaagatgttgtggaaatgctgcccagtgggaggcaggcttggaaccgcacgctggtctggctggtgataatctagtctagatgaagatctggacagcatccttctgctcagccactagcctctctttgctttctagtcagtgtaaaaagcatctcaaaaccattgctttcccagacttcagtctcctgaaatgtgtgtgtgtgtgtgcatcccatatgtgtgtcattttgtgtttctgccagcctttctgttgaaacttgccagagaaaatgacccacctgcgaattggcaaacggaacctgactgaataaaaactccttgattcagagcttaagaaacaatccagtggatttcttactaatctgggtgttcaaaatagtctttctacttacttgggctcaatattttggaagctattgtggtgaaatgagtgatcacgttggaattagacactgtactactaattgtgtgtccttggaaagttacctaacatttctgagcttccatttcctcaacataaaatgaggataaaaatgtccatcatgcaagattgtcctgacaactgtgctactgtctacaggatcctaagaaagagcaactaaaattatgttaatgttattaattataattttaatcatcaatactgttaataataataaaagactttaaaataatttcctcgtttttaacttactgtaatatcaactgtctgtggtagcctgttcacttgctttgtccttagtcttgtgatccatgtctttttcttatctgttagttttatgctgtctcttcacaagttctttttctgcgtgtgtgtgtgtgtgtgtgtacacatgtgtatgtatgcaagtgtgtgttccaacaggggttcccacttgcccattagaagtttatgctggggtctagataataaaagtaagaaatccaggactacacaaatgttaactgagtggattgaagagcaagagagttctcatcacagccaaacctatgagcacaatgcattgggcatatcagagaaaacgaagatctaaggtaaggtgtgaaacacagcacatgcaactcgaaatgctgaggggaagatctggtaggggggcctggtttgtgaaactcctccgatctgggtgcgccagtccgggtgcaatgtccagctcagccacttgtccccatgggaccttgagcaagtcactccatgattccatgcctcaggttcctgctctgtgagttgggaataacagagcccctcccagtgggttgttgtgaggatttggggagttaatccaggtaaagcccagcacagtcggcattctataagcgtgagcttcatcatgatcatcttatcactttgcgtgcatctggccctcctcacttacaactactgcaccccgtggtagaatgcagcactcatccaacaagacttgcaactcacttcatctctaaaatgtaacaggtccaggtaaaaaagggcagattgaacttgtgggcttacctctagaataatatcactaaaagtagaaattcaaatggacaaagggaagaaagaagagacaacagcctgtggaagatgtttgcaaaatttggaagatggaaagcaaataagagaatggcagttgatgagtgaggggacctccctgccagaggatggggggagtcagtaaagggaaaggcaatttgcaacatacgaccctgagagctttggaaatttgaggtcactcagagggtgggagcagggcaaggaatggggctgaaaacatgagagtgtatgagtgttggagaaaggggaaattcaagtgctccctcctcctcccacatcccctttctgatcccctgcagccaggtaaccatcctgtgcctagcaggtaatttagggttcctctccagagagaaatcagggactccaggctctgcagagtgagggaatgaggcaacatactgaaaagggggaccaagtgaatggcaaggtacctcccccaggatcttccctctacttcaccctcagaaccctgcagccaggctctaacaaccccaccctcattccaccaccctttccacagctgacaacagcagtattctcccccaggagatgctgaccaacccaagagaaagagctacttagacagtcacttatgggtccccaatgacatagtcaggtgctgatacccatcacggcacacacccccagccaacaagccccacctgggcacacagtttcctagtgaattattctgaattatttcctagtgaagagcatccaaggtccaccagacacttgtgaaaaacttccaagcattagaaatgatgaccaaaatctaacaatcacgaagaaaaaatgtggagcaaaaagagatgttttaactttaaaaaaaaaaactatcattaagatcctaaagataagaacaaataatacagccattaaaaaaacagttaaagatgccttgaataaaaaggatcagagaggaggttcaacatctaaataacaagagttccaagaagagaaaacatttaaaaatggaagagaaaattctcaaagaaatcatacagaaaaatttcccacaactgaagaggcccactgagtaccccacataataaaaggaagaagaccctaaacaaggcacatctctgtgacatttcaggacactgagatgaaagagaaaaacctaaaacattcagagaagagaaatgggaaccaggatggcatcccaagcttcttgataacaacaataagagctggtagtctatgaagcatcactttcactttccaaatcgtgagggaaatgtttcttaaagggaatcaaaggcccagccaagccatcaatgtgaagaactacaccaaccatgaggctgacaggataacctggagacaggggacccagcatgaaaaccaacagaatcctagggtgccagagggcagagatgccaggacagccacgcctggaaacagccggttccatctgtgagcacagggctccttaaagcaccctcccccacaacaaaacaataaaaaccctgagagatgaccaaattcattctaacacactgaaaagaggaactggttctgccaaggagtttaagggagtcttattgtaagtacttagaaaaaccaaggcaataaaaaaatcattgaaaatcaatgaaaaatcaattgaaaatcattgaaaatcaatgaaaaatcaattgaaaatcaatgaaaagttattgtttttgaaaaaatcgaacattacagcacactatatgactcagttctaagtaacatttacatagttataataatgttacaaatgcatatcaacttaaccaacattatgatttacctacattggaaggatggagaaacaggagatgggggaagggggcatgagctaaattctcatctaccttaggagaaaattgataatgtctgatatggtttgcctgtgtctccacccaaatctcatcttaaattgtagctcccgtaacttcaacgtgttgtgggagggagccggtgggagatgattgagtcatggggtggtgtctcccacactgttcttgtggcagtgaataagtctcacaagatctgatggttttatgaggggaaacccctttcacttggctctgatctgtcttgcctgccgccatgtaagatgtgcctttcaccttctgccatgattgtgaggcctccccagccacgtggaactgtgagtccactaagcctctttttctttataaactacccagtctcaggtacatctttatcagcggtgtgaaaatggactaatacaaagtccaaatgaaaagctcatgaaaacgcagtgatgtatcaacaaggaggtaaatgacagaagaaacagctaagaggacagcagttacctctaggaaagggggctctctgggaaaatggaaggcagagaactgctatttttcattataagcgcagaaatactatttgacttttacaactatgtattagcatgagaaatataacaactagaatagaacagtgataaaacatgtagaaaatttcacagtgaataaactaacgcatacatagataggcaaccgttttctgagagtcagttgtgaacccagaaaaggcataaaatccagttcttcagagccatcccatgctcattgcatgtaccaccagtttgcttcctcccaaaattcacatgttgaaatcctaaccctcaaggtaatggcattaggagctggggggcctttgggaggtgattaggtgttgaggatggacccttcatgaatgggatcaatgcccttataaaagggaccagagagagctcccttcaccccttctaccatttgaggacacagcaagaagatgccatctatgaaccagaaaatgggccctcaacagacaacaaacctgccagtgccttgacattgaacttcccagcctccagaactatgtgaaataaagtcttgtttatgaccatccagtgtacagtattttgttatagcagcctgaatgaaccaagacactcatcatcagggctgttgcatctgccccttcccaccacagtctcactaaagcaaccggaaagaggcaccaaatacgtccccctttgttatgttagtaacacagtcatgttataatacaaaataaactaagcaatgtcaaacagatcaacataattatttagtatgacataaacctcttccaaatgcacatgcaaattttttcattatttaccttttaaaagccttaaagcttaaagtgaaaattagtgtgaaaaaaaaaacaaatttctgaaaggtaatttgtcagtctatatcaaaagattaaagatacatatctttcatcacacaattccactttcaagagcgtatctcagtctgataaactacagcatggtttgaaacagtaattttcatcttggaggcatgtgagaatactgattcctgggccccaccccaagacagcctgattcaattggcctgggataggacctgggcatctgcattctgcactcaagattgggaattcctggtttataatatagaaaactagaaacagcctgaatactcaacagaagaggactaggtagataaatttataatgacagagacatacgatggaatactagacagtttaaaagtaatgtggcattaaaaatatcattaagcatacctatgaacatgggcagatacttctaatgtgctggtaagtgaacaaaacaggtgccagcacatatatataaaagtgtatatataatatgatcccctttggggaaaaacatgtgtataagagagaaattccactatctggaatgaaatgcattacttttcaatagccattatgtctgagtgcagaaagatttaatttaaatacttttgttcatctgtatgctcacggtaaacaaagtattattgacaccatcttctaaagttcaaaaatgctgttatatatcacttgtaagttttaaacattttagtactgttcatatagatttcacctcacaccccaccctaaatccatatacacagacccactcaaactctcacctgcagattctcagagcacactacatcctgccaagtctccagcgtgaagaacaacttttgcataggtttcatctttcctttgtattaataggtaacaaagtctggctgcctcaaactcagaacatccttgcaacactgttacacccactgatcttccaagttcaccttcacaaatgtgcaagggatgagggggacaaagaccaagtcaccagcaccactcctgatcccccagattccagcccaggtaaaccattcagcatcattggtcaaaggtattgggtcactgaaggaggagaggggtagaaacaaggcattgattcaaatacttccaaaatatgtatgtgttttcccaagcagctgttactccccagcttgaggaaagtgctgagttacagatgatggagtatgaaacactgagagagggcacaccctgtgccttcgcagcaagaatggcagagctacagtggctttggtgttttacttcacccacttttatgcctactcttttcttagcgcccccttcccttactcattgcatcaaagtgatccactgaaaagaattaagtcaactgcagagttccagatagctatcctcaggagttttaaaacttaagatgaaagcagtcagggaattaagactaaatcccgaatatgtaagaaaagggctttcccacgtggcacaatacacgtactgtctgcttcacaggtccagcctggtagcaatcaggcaggataccagagcacgcaggaaatccaaaattaggttttactacctataatggaagatttacgggatggtttaattggtagtctcaggactaaaacctgaagcaggggaacaaaaacgtctatctggacacagccagtgagcccacgtgcaccccatgacactcgctcataggacacacaggcccgaggctgcaggggacagagtaaggtcacaactcctccttctcccaaccttgatgcacaccaaagccaacaacatgctatttcctgttccttttatttaagaggcaaatttgtttcttgtggtagaatgggtcttcaagctacacacacaaactcaggtgttccgcaaaacaaaagaactcattcaattcagtcctcccctgtatttccaaaccacaggggcaacactcacaagctgcaaagaggattccgccccaccgggaatgcatcggtctgcacctgtctgttgccattttcagggttagcagggccactggaaaatttcctcagtaccattttgggtcaatgtaaaggataattgaagtgcatgtttctgtaaattccacgtgctcagagagatttcaagtaaacacaggaaaataagaactgtgggcttgagccatatgttggctggccacgtggggcaggaagaacacacactgtccaggcagtgagtaactgaaaaccaagtgcccacagacaccatccactgccagaacttgggaagctggggtcccaagggacagtcccctctgctcaccctctcccctcctttctttctcaccctctcaacaaactttagtggagttggctttttttcctagaggccttcatagccactttttcccctctccaggtggtagcctgggacctactgtgcagaaggacacacaggtctgaattgaggtcaagccaggaagaggaagaagtgcagagcagggcagccactggcttctgaaatccaatggaagaggcggcaccatttagtagcatgacattctgtctgcaaaccaccatgatgatattgttactaagtagaagaatcccttttaaaagaactttcgatatattataacatactataacaagatgggaagacattttccttttaataaattgattttcttaaaggagatttcaactttccagtgatggacacttttcctggcttccacttgttttctgaaggtttccatttgggtgtgatttcttagcaaacaagagccttcccaaacattgcctgcagacatcttggtctgtagaaacaccttataaggagatcaacgtataacacagtctttttctacctagagaattagcaaagggtgaaatttggtatgacaggggtcttccctggattcctttcaatgtagtccaaggaagaactaacttaggctgaattctattaagacaaggttatcacaatatttacaagattatttatcaggattatatcaattaaatattttgggggaaaaaattgccatacaaaaatcatattaaaattgagccaagcagtgaaacaactctgaaatggcctagaaataacatgtatttgatattcactttttctgaatacagatgtgatcttcatgccatcattgaccccaggtggtaaggatcattaatgtttctagaatcctacactgggcagctgatgcctgtaatcctagcattttgaggggccaaggagggagcatctcttgagcccaggagttagagagcagcctgggcaacacagcgagaccccatctctacaaaaatattttaaaacttagccgggcatggcagcatgcacttgtagtcccagctacttgggaggctgatgtgggaggatcatttgagtgtgggagatggaggctgcagtgagctgtggtcacaccactacactccagcctcagtgacagaatgagactctgtctcagaaaaaaataaacgattttaaaaattttaaacccttaaaaataagtaaataataaattcctacactgttgtacagttaacggccccaattactaagctcaaagggaattacccagaaaaggcaagaaaaacctaagtgtgaactatggctatagagaaacaaatatatggcttgtaatataaataggtttcatatacataagagtgtaggcatacattgcaatgtatcatctcatctgaccctgctaccaaataaaccacaatgtgattttgctactgtggaatccactgtgaaacgagtcatatttcaaagaggtatttttagtgatttttaagggcaagaattcacagacttcagatctgggttccacgtgaccatgacaagcacttggtcagttctgcggcttgggctccaaattcaatgtgtggatcaccactgactcaaactaactctatctgtaagatgattcaaaagagacaatttggaaaaacagaagggaggaaagacttgagaaagagtgagcttttacaactaaacagtatttgcttgaatttaaacaccacttaaaacatagacaacaaagacaaaaagcatcagtgaaaatgtatgtcccttttacattccaaatacaggcccagaaagcaataagcaaaaggcacagctgggctctgtatagccgacttgttgatgtttaatgcaggtaccactctgatctcagcccccagatagaagcatatactctagtgatggcccaggaagacgtcgaccagcacaaagcatcaccacacttcccacattctgagttggatgcaaccattctcttagaaacctagtcttgactgggtgtggtggctcacgcctgtaatcccaacactctgagaggccaaggagggcggatcacttgaggtcaggagttcgagaccagcctagccaacaggacgaaaccctgtctctactaaaaatattaaaaaatcagctgggtatggtgaaatgcacctgtaatcccacctacttgggagactgcggcacaagaattgcttgaacccggaagatggaggctgcagtgagcaaagatggcaccactgcactccagcctgggtgacagagggagtctctgtctaaaaaaaaaaaaaaaaaagcaaaacaaacaaaaacaaaacagtcgcttctgcactcatggtaacatcctttaccatttaatctctcctagaagacagggcattgccataccattactcacttgaagatgagaagtggaggatttgttaggactgcaggtgatgaggagagactcaaacagaatgttagattctgaccgatctgctctggtttcacacacttctttcccttcctaagaatctgcttttcccttcatgtactttttcctgttttcagtatcactgggtcatttctagtaactctgcttaagtgatcctgtcagctacagggcgtgggtgggttattcagctctgcctcacagaacactcaccctccatctctgagtcagttgccttttaatggaaatactattcgctgatcatgttcataccggcccagttttgtttctcttgacaatggcccaggtgtttttctcttctgattgagttttggggtaagctcagcatctttgttgttgttgtttgttttattacatttccatttttactggaggggaaagatcagagtcaatgtgatccagctgctgcacgtcagtcccgccacatgacctgcactgttacatccaaagcgtgcagggaaaaggctgcgtgctcaggtccagaagttcataaaggcagcctctcccatcagctcaccggtggctgccagcctccatgccgccttgctctctctaggctactggtttttgcaaccttctgcttttgtccactcataactttgataagtaccgtgtcaccttctcatacgtggaaaacatgtggtcagcgattcggcatgtttaatggtgcttgaacaatacaaaggggagctgtcatccatcttttgttttctcattatcagttttcaggccacgttctaaacaaggacgacaaccaacagaacatcattccctggtgtcccagtccttgcttactttgaatctcctcaccaccttcagtcctttctaaggtcacgtacgggcatccaccgtcttttttcctaaacagaatactttgcaaagtcaagtattggcatttcgtatttaagccatgcatcctcaaggaggctaaaattagttcttgaaggatgaaaaacgtcttattccttttctgtataaagcacagatatacctaaatgtagacatacgtatatgtataatgcaaagtactaaaacagtatatctgtggtattaaattttcatgtgaggagggacaattaggaaaaaaaatcagaaaatgctttttaggaggttgatcatgaaaacaggaggttggtcatgaaaaaaaaggttgaaaaacactaatttaagcctaaatgtaactacattacaaaatgtcactacttcttgctggttttggcaccagtgcctcaggtgacacagaaatactaagttttcttttattctgatatgcttaaggtatccccaaaatgatttctctaagttgggaattgaaagggttatgttacactcattcactctttaacaagtcacatacacgtcacctcctattttagaagccaatgggtattaaagcacaagaaataaaaccactgaaaaagcaaaaaataaaaaggaaagaaataaagactcggcactctgacacagatgaagcagatgattatgtttatttaaaacagcaacttattttttaatgtctatgaactaaagatttctcaggacatcttatttcatgttaagtgtccaatgcagcaatctttgccttgcaaagcccattacaaataggcttgtgcattccagaaaggaagcatgcatttaactttcccaaatatgtaatatgcaattcttttttttaaattttttacttgcttggagcaaagactgaaagcaagtatttaatctcgcttcctttgccagtgcaaacgtaactaattctgatcctcatttccatttcttccttaatctttttaaatcagggttgggccagcatttattcccaaccttttggagaagtagcctgtatttcaaatggggccgcgatgctaccgcatgttgtcctgaccagtgccgtcctgatccttgctggagaaagaaatggaggcattttactcacaatcacagagcttacgtatgccagcattacagaatgcaaaaaataactttgcaacaatctgaaagggtaatttatggagcgtggacagtaaatggggtatgttttctgtcctgaaaatcccagatgagggcaggcttatgaataattttcaaaaatcaggaagtctgtggaaatccctactgtcttataaagattgcaccgtgctcatcgcatctcccacggcctctgcctcctcctccacctcctccgaggttccttggtcctgactcctaatggcaagggccaaagaacacaggcacctgcctccagcaaatccactccgattccccctcattcccagacacaaatttccatgaaaaccagacagaggacagaaagcaggggcaggatattccaaaagcacttcagatctgcagcctgatttcattggactcgctggcttgtttcttttagtccctgggtgtgttgactgcaggagaaacctcactaacgacgacacttcagaactgtgagtccaaacacttaaggaaggacgtgcccaggaggaaggtctagaagctcagagacagtgaggaaggggcattgctcagcgatgcttagatgccttcatgagctgactctactgggagtcacttgtcatgcccctgaatccacccacacatctctataacatatgaaaactgttcagcccaaaggaaaaaataaactcgatggttctcattaatccaagtttaactaaacacaacagtttccaagagtacatttcagccatttcgcacccgcagatacccaacctgagaagctgatgggaaacggctgttttggcatcaccgagggctgcggcaggcagcacccagggggcttctgtctcccctgtggcgctgcagctgagagccacacccatgagctgatgacgtagcgtttctctcaaaggtctcccttgatgatgtggcaaactgcaaggaccaagcacagaggcacctggacaccaacccttccctgcgagccacatggccagtcaaacgttctggttaccggggatgacacgctttttccgacaagattttaagcacttgtggcttacatcaatgtggtctcgtattcattgtgtgtttagaccacttgcctcgcacgttctcatatttacacatgttcactgaacgtaacctcaagtgaattatttaagaagccttaatgtgcttcagactgctcaaatataatttagactttaaattaaatttgtactctgatacgaaactgcaatgcttgaatgcagcttacggcatcaagtggacatgcaggaggccttggaatagaatttcagttacccctaaagggctcacacctagtggcccacgttccttataggacgaaacaagattcaactacaaaatccaactcattgcctacgtttgaaagctggggagcctgcagtacacaagataaagtcttgcttctccatttgtccttacgtgaccctacaatgaagcatcgctacacaccagagacgtataatgctagacgcgagaacacacagtcatgctccttggtcagaggttttgggtatggttgggtgttttaataaaccacaatattccttctccttcactgtttggttaccaataattgtgctgccttaggtgtaaaattcaatatggtgattagagtctagagaagccacacttattttatttagcagtttttgttttatttttacagtaagcactgcccactgggaaaaataaaccaaaataaaaagagtgaaattcccttattatgcactagcgataatgaaaacaaacttatctacaaagaaccacagacgagaaatttgcctagagaccagctactggaactaaaaacaaatttcttattcaggaaaatgtgaatgagtaagaatctgctagtgaagtttcttactttgcacaaaaaattaaatgaaatcttaactttaagagtagcataggctgggcacggtggctcagcctgtaatcccaacactttgggaggctgaggcaggaggactgcctgaactcatgagttccagaccagcctgggcaacatggcgaaaccctgtctctactaacaatacaaaaaattagccgggtatggtggtgtgcacctgtagtccctgctactcaggaggctgaagcacaagaatcgcttgaacccaggaggcggacgttgcagtgagccaagatcgcaccactgcactccagcctgcgcaacagagcaagactctgtctcaagaaataaaaattaaaaaaaaaagagtggcatagttaaaagggtagaaggttactcaatgacgcatcacgtatagtacacatatagcacactgataataacaaatggcatgtaagcactgtggattgacttcagaagacttttccataagcttcagtatcacaaacgaagggaaaagcctgtgttatgtgcaacctgtcatgatcaaatagtgtgaatatgtccttgtaaaggttaattctatagcaatacatttagttgatgtgctttcttcctctgggattctagcactttaagaatgccgttcttcaaaataatcaattgtattattctcaagaaacatgcaaaataagaaatttgtcatcaagctggaattatctttaaatagaggatattcaaatagcatttttatgcctggagttgtcgcagcatgattccggcaaaagccgcactatttgttagctggcacacagagttttggcctgaaattcagtattttattttaccctttaaaagcatgaagtgactcaacaggaaattatacatacatttttccctccaatgtaaaaactgcagatctagtaccgaacatgtcacgctggcattcaattttctattgctatcatatctggttccttagtgacataaggtcacaaaacttctactcctgtggccaagagacataatagatgttgcggttgctcattatattaaatttgaattcctaagctaaacattctagacctgcactattcggcatggtggccactagccacatgtgactatggagcccttgaaatgtgaccagcccagatggagacgtgctgtaaatatacactacacaatggattttgaagatttcatatagaaaaaaaataaagtcaaatatctcatccatattttacactgattacatttgaaatggtagtattttcagcatgtgttacataaattacattattaaaattaattccacctgtccctgtcttttttaatttggctactggaagatttaaaactacccttgaagttcatgttctatttcctttgcccagcactgccaggaccttacacggactctgcctccacgtcactcgctcccttccggtcacttccataacaggcccgccactctgaccaagataactacacacagcagagtcccatgggtggatctcagcatccgcctgcctggttctgatgctgccctggttcccactactgtgtgactccaggcaaggtgctcagcactcctgagcctcactgctattctggaaaatgaggacaattagagcacctcctgcaaagagccacagtgaagacagtcctggcaaagtgtctcctgtggctataccatctggtgagtgaatgtcacctgccaccttccacaacatcacacctctcccttcccttatgtaagactgctttcttccctacctcttaactttacacctgagatattgaagtaggtgtctggtctgatccctccaacactccagaggatttggtcagtttccacactgtgtgacccactcccaggtaacacttccaccctccaaacacaccagcaggcctgactcctccaccctcccgcccactgctatctctaccattcccgccaatccagatccaacacgccatggcacagctcaagggcctcagcctccgggtagcatgctctgatcctctgatcttcctatggaatggtgtagattgcttttggattgcatgattctattttatgttatttatactctaccttgttcccaaaaagggactcaaagtggtctacaaggatatatgcaatatgacaaggttgtttaaaattcagaagcaaaataaaaaataaagatgaagctaaagagaaacaagggtaagaacataaactcgagctaggaatgcaatggcccgccaggcaggcctcagggtctcacatatctgctggagttgggtcattcacacgtctccaaataatgaaatccaaccaaatgctcagacaatgactcctgatgctaaggctaaaaatgaaatcctccaatgattccataagaaagaaggacctgtgtgatagcaagcatgcccaagaacggccctacagcaaacccagtgtattgcacgaggctgtctccctgctcgggaacatctcctccattgccatacagtctagagccctgttcactgccatgctggcccagttcaaccaggtggtcccactgaggatgccactcttgttggtgtgtgaactcatctccttcgagatttcatgatgtgcacattcacccccgttctagatttcatgacacaagcattcaccccttttctagattctatggcaagtatgttcacccactttccagattgcacggcattcgcattcaccgcctagattctagattccacggcatgcacattcgcccactttctagattccacgatgtgaatgttcccctcctttctagactctgtggtgtgaatgtctgccccaattccatggcattcttgctcacctccctttctagattccatagcatgcggattcatcctctttctggattttgcctccctgaaggcactgtgcaagtcttctgcatagtgtcttgcatgaagtcttacacagaacataaggcaaaaacatggactaaatggacagcttgccttccaccacacagtctgtagcttctagcctcccttcctttgcacgtgcctttcccaggatccggagcaccccctctgtggatggagtcctgtatcttctcaccttgagtcaaatctgactgcccgctgatctctgcctactcagcattccctgaattctcaggcattccacttgtcctgtattaatttccacctgtaggtatttatcctaaggacaccgcatttagagtgtccttgcaagaggggatgctcctctcttcagctaaacttagctatttaaagtaaaaagggtggtagttttgtttacctgttaacacaactcatggaagagagaaaaattcaagcatgccactaattgctgcagtcagacagacaggtggataggcgggctccatagcggaatgttctggcttctcccactaaatttgcagttgttcgtctaatctctagacgtgtcccgtgtcttaacagtccctgtatgacttatgctcccacctcttgtttgggacagtgctctcatttaatagatgctcaatatattttaattaagaaatgtattttcacgttgcttaagacccataaagaacaattaatacaatgtaatgcttaattttgcaaagaaaaagtttatattgatgctaaatgcatttacaaatgtgctcgtaatgtacaaacaaatacagcccttactgtgggttacacatacttatgaaatgattttattgacttacctttggttttacaatttggctatggggtacttagaagaaactgcccttgtgggacattctgtctaatcacttatatttacaagccttagaaaactgtaaaaatatattcagtttcattaagagatattcgatcttcagaactgatactatttcatctataaaatccttttactggctgggcgcagtggctcacgcctgtaatcccagcactttggaaggacgaggcgggcagatcacctgaggtcaggagtttgagaccagcctggccaatgtggcgaaatcctgtctctactacaaaaattacccaggcctgttggcaggtgcctgtaatcccagctactcgggaggctgaggcaggagaatcatttgcacccaggcggtggaggctgcagtgagccaagaatgtgccattgcactccagcctgggcaacagagcaaggctccatctctaaataaataaatacataaataaaatccttttactttgatacctcaagtagtaatcaataatatccctctctgttctaatggcagggcctttaggtaaggtttcagaatttgggataaatactaataatatgctgatctaacatctcttctccagaagactccctagatttgatttttactgtcattatttctattttaaaactctgtagtgaagtaagttttactgtcggggtcaaatagactagaaagtacttttcaatactgaagaagcaaatttttcctccacttttgcttattctgtcctcttgctgctgtatcttgaactgcagaaaaagcaagccttgcacaaggcaagtttaaactttgtgcaattatagacccagatttgtaaatctggcagcaggctcacatcagctttgtgaggttgggtataattttaatgagaatccattcaacatatgaaatcttagaatgtttctcaattagcacttggtttcttttcaaaatgtttttacctcatttcctaataaaagaaatctcagctttctgatacatttaattaaaaagttttatgttgagattgtaaatgtgagtggtttctgtttcaaaacatttcattttgctagtacatccttcacttattatttatactctgcttagatctctgcatttcccatgcaaaaatcctgaaatgcaccttcttcagtgctgaggtctaaagtttccccttcctaagtagtgccacagtcaccccctcttcctcccacagggccctcataatagcttctttcagtccttcctctgaaccctgagacccccgttcactctcatgtcaagcagaattccaagccttcattgcacacagaggtgggtccagggaggtatcccgtgtttctgaaattcctgctttgcctgtgcctaagcttcccaattctcccaagagtcctcattttaagaacacaatgcaatgctagcattgcactagcattcagcatctcccaccatacattgcaaatggataattagcttgattgctaggagattcacctgctatcccctcttctcaccctttagcaatgtgtgtggaacgcacttggctccgaacaaattaattgtgtgtgaggggtgacatctgactacgaacaactaaaaagaaccatttaatcaggccaaattcccttcaggcttattgaggcttgagtgtggatttttaaaatgtaagcagcactgtcactgtaaccatgaaactgtcatggttttaagaagtgaagttttgggggacaacaacatgaccaacagactctacctcagcatccagttcccagattagttaatacaaacttgggccccacttttcaacagaagcacagctctaagtaaaggctggtacccagctctgccccctcaaattatttggtgaacaggccaaatgggaggaattgcaggtagtactgcagaatctgcctgccttggaaaacaggctttccatgaaatacagttttaaggtccccagaggccagggctctctccctcccctactcttcaccgcgccccccgccaacccacacgtgatgagaaaccactgcccctgcagaggccccagcagcaggcaagggtctgtggaagaaagagaggaatattacaaaggggtttctggctggaggggggttccagggagggcagagaggttcaggctccaaagctggcagcagcccctacagatggaaagctccagtgacaggacccatgaaaggacactgcagagcttgtcccatgtcattgggccatcgagacatcaagggctgcctggatttcaggaactcacatctgtagaccaagaaggaacagcacgttcccattgccaatttcaatcaatttattaaactaaggcaataggtaagtaacagatttactaagatattgggattctcttactgtccatcttagttcagatggagattcacaacaccagctaatctgattccaggatgcagcttctgacggtgcacaagctaatatttccttaagatagtcacacaaacctccctgccaggcgtgcagaaaaatgtgcacgctccaatttagtctttcttttactttccaactttaagtactttagtgagccccaagaatgcatagccactctttccacccagttagagagaaaattaatctttctaccaataacagagaatcacttaatggaaataggacgatagtacttcactaaataaggcttcgctcctttgctcccctactctcaaaactgaggttcaaatgcatttctacactttcaaatgaacatgtgggaacttttgctgaatgctgacatcaagtgaaaataagggtttcctattttttaaaagtcattctatatatgcctgttttctttcctatttcctagagagacagcttttcccccccgagtatgttttgcaggggtaataattactgcaataatgttatccttaaaagggagcacatataagacaaaagcaggtacaaaaatctcattcccactaaaacaattcaaaatcataggttaggctttaaaaggaagcaactacaaatctaggttttaaaaacctttagacacactaaagatttgtcccagatcacatctgatgtctatttctctgggataataacaaaaaaaaagaggtgataaattaattcaaatggcctattttacatacttgaaggatatttccattgtctcatatagccattctgaataggacagagtcacataatgaaacttcctttgcacattctcctgaacacgcactgagtcaagatagccaaaccccttactttcattgtaaaattactgtttctcatacgcaatcagggtctcccagattatgacatgcgaccctaaaaataggagaacttaaaagttagtttaaatctaaaacttagatccagcgctccatttttagatgcaccctttaatttcttggttttgtctacattttacttatacttaaatttagcaaagtaattttagctcaccctccttcactaccttcactagactttgcaatgttacaaacatgaagcattcaagcctctttctaatatgaaaatgttttaaataaaagataaagttaaaagggaaagatgccccttttaactttaacttttaacttttttagctatgttgaagaactggtttgggtgacagcccagccattggaaaagccattggaaaactcccgctgttgtttatttacaaaataactgctttcaatcaatcattgtgagaggtccgtacactgacaatgcataatggacaactaattaactgacccctaataagagtgtgggaaataccagggagaatgctatcatgcaaggaacagcaacaatatggaggggtggctggtcactgccaagcatgagcatccccaaataccgcagtgattttcagagttttcaaaaagccctactcacaccactgccactaagtaccataatcatcggaaactgtgccccaaagatctgaacgtccctgttacatcagcctatttttcttacaaatgttgctgctaaggttcaaattcaaggtgtagaacattaaacaatagctgtattgtgaaggaccatgctccctgggaaagcccaagtaaccttacacactggggaaggaaaaaagaactcctttgccatactcctgctctctggaaaactgctcagacgcaaggggtaaagaagcaaagaggtgacaaaaagagacctgcattcagagagatcagctgtcaacttaaactgagaagtgacctgatgcctcacagagctgggattttgccaccttgaccaaactgcttcccaggctccataagtctcattagaaacgtaggtggctctgtgtcgacaccttctcaatggagttctatgaaataacaggcatcagacatttattcactatgacaatgtcttcccaccactccagatcctatgaccgggactgacttgctatcggtttttgcctgggaataggaaacgattccagaaacattagctcttctgttttgagaagaaataaattcccccttttatttcttttttgtttaaagatagcaagataaaaataaaaactaatattacttttagaaaaaaaaagtgttgaaagtttcctattaccctacttacaatgtgagatgcatttaaaagatacataacgtataacattgtagaatagtatgtgagttacacattccttctgacgtctttcagagatgctttccttcttacttatgtatctggtattccattgggatcttaggtcttaccacaaataaaatatctgattttataagattaaaaactcaacaaggtttttctttaatataaaagcaaaacgtggaacgtggaggggggaatgtttatatacaggtgtgaatgcagcccctcacacaatcccttcaatggtaaatgctaattttctaaattttagctaaagattaaatcaccaataattcctcatgaaataacagataaacgtgaaatcatgtactacaattctactctaaatttttttaaatagaatgaagtaattataaaatgttacaaaagagaagaaactggaattataagtgctactggaattatatattccttaacaaatatcttgagacggattacccatttgctaattcagtgtactttccaaaagccattgacccaaaccgaagctaggattaccaaatggcaaatagcatttgtgatgtgtgtagctcttctaaagcctttcttgagaattgtaaaacttgatatattagccacaagtttacatagctcaccgtttctgctagaattataatttcaatggtgtaattagcttattaataatttgacacatggtgaattaatttacatggttgggttcttcgcaacgtctgttgcctgatcctcctgtggatgaaggctatgagctctggcctgccccgggagcgggcaccagccaatgccagcggagcaagggttaactttgggactgtgacagttctcccttcaggggctctaaactacttggagagaatggaaaacagtcaaaaatagtcccaaaggtaaataaactctgtgtcctatgtatgtcacccagggaagaataaaatgtatttttactcacattgaaagttttctgaactacaaaagctatagagacatgtacagagtgaaacctgtagcacatacgaatatgttattttgaaagataaaggaaactatctttagattaacgatgagttgtattaaatccacatcctcattgaaattgtttatccattttattgcgcagtgtagtctgctattaataacagaatttgtcctgtacttaaaagataattaatgcctctatgcatctatgcaacataccatagcaataaacggacgatgtatttcagacagaaaccaggtaaggctagctgataaaatacagactatattttttttaacatgccaagttttgcaattagggtggtaaactggaggcaaataaacttaacagctgcaggctgaagaatggaaaggtgaaaagactgagactgagagtgggaaaggaaagggaccgctcctggcgctgagagctggtcccagagccggtgttgcggggtgtgcgggaaggcgccgtcgggggtcattccaccatcaggacccagcggacagtgacaacccagcctcaaacctggtccctactttaggccaagcgtcagcttttttagttcaaccctgatttccactccagacaaggacaaataacctcttggtcggggccccagatgaagtccccgcggtgtgctctcctggcccttgtcaatttcggggtgccccctcctctccatccgcacccgactgcacgcgcctccctgggaccccgcactggcgagccgtccctcccggcgctggacgccccacctgtcccggcgccgtcggaagagccctgcagagtgagcccctagggccaccccgctgccttcctccccgtccccgcagccgctgtagccagcgtgggagccgggcaggtcgcgtggggcgctggacttaccgagaggttagcgccgccgtcgggggagggcgtgtcccgcacgtgtgtgtccgcgcgtgtccgcgcccgcgtgtgccagcgcgcgtgccttggccgtgcgcgccgagccgggtcgcactaactccctcggcgccgacgggctcagcccatggtgtgggcgccgggttcagggaggctccggctcccgccaatcgcggagcagggcggccgccccgacgcgcgacttgcgaacccggagtgcgcgccgggggcggggcagggacgcgtgggcgggaatgcacgcgcgtggccaggtgcgcgtgggtgcgagcgcgcgggagtcttcgagtgcgcgcgtgtccgtgtgcgcgtgggtgtgggtgtgctcgcgtgtccgtgcgcgcgccctcggggccaagagcgcgggccgcgcgggcaggtttggacactacgcgccctgctcgggtttaggacgcggctggcggctccgggaggaagaggaggaggaagaggaggaggcggaggaggaggaagaggaggagggaggcggaggagcagaggctgggacggccggaggagagagtccggccccagcaggaaaggaacccagcacgcgactactggaggggcgaggagcaagggaaggaccagaggggaggagagggggtcaggggagggaaagtgtgggagggggagccgcgggggtgcgcgctcctcctaactcggggtcgcttttagcgagaagtgatatttttccagcctcattgaaaaccgttgcaaacattgaaaatagtaaaagtgaaaacggttgcgacactaagacgtttataaaatgaccgcggactgccctcgatgctgatgagaactgggacgacgtcgcgcagagcgtccggagggagaggcgcggtgcccgggacctcggtcgtggggaggagccggatacagccgccgggacgcggggatgccgagggcaccgcggcctggtctgaccgacgcacgcggtgacagccgcccttgggagacgacggcgtctgcaaccagcagcctccaaagggtgcagccaggaggctcagcttgtccgcctccggggctcggggctaagccccttccagaagttttcgtttctacgcgaattccgaccgcaaaatccagcttacctgagcgccgctcctcttctctcatgtccctcgggggccgtcacgaccgtcccggagcgatctctaggaacctgtcccgcagcgatctcttgcacactctccccattccgaccaagtgaaaac

SEQ ID NO: 1007 - DNA, 281756 bp, Homo sapiens; identical to SEQ ID NO: 1006

SEQ ID NO: 1008 - DNA, 204921 bp, Homo sapiens
tttggtgtatttttgagtagtccaaagtaatttttattctctaattagtcacctcacgactttatttgaatgaattaatgagaagctaaataaactagctttttaaaaaatattttcttctctttctccaggcaatgggtcactttggggcgctgcagaacatctgtgctttccctgtgccccatcaccttcccagctcctgagctgtagccatctctgctgcacctgctgtcagagggcagctcctccggctcctgctcctgggttgcaggtgccacatctgtgcagaaggcttaggagaagcagtgagccttctaactgcagcagtcctgacaaagcactttgtgaacccctccgggacataagggcatcaaactaggaacaaaaacacagtcttgactgtgatttggtgattttaccacatacaaggcccgaaagccaattgaagacaagaaaagaagacaaatctcttgccagcaggagtaagattgtacaggagtctgagtatacatcagggcaagccaagagacagggacaaacagagagaaaaggttcatgcaattatgaatatgacctggagggggctttggaattagattacaacagtaacagagagttaatgccattttgaaacaatttaagaattatgtatttgaaggaactcagtattatcatgttatccaaaattatcccagttgctcataagacttgctaataacctggactgggggtggagggttgagggatctaatggaaaacatctgttaaaattgaatatgataatcatgtcttgtttttatgatcttgctcatgagacagtcttgaagagagaactgagtgattatccaagtaaatgtgtatttctatgaagaatgtaggtgtgtcttgactttgcattccaaaataaaaatgactgatcttttccattagcacagtttgggtcagcctaactgccagctttcatgattgtatttatttattttccctaaggagatacgggcactttgtgggccttcccaggctgctgcaaaatgatggatggttgggctccgtctaatccaaatgacacggggtgtcaggagcattggtaatcgtgtcctgccgacttcaaagcccactgccaaaacatccacagcacagaggtttggcaacttcacataatcatagcaaaaggactgcaacgtgaaaaaaacaggccctgaaacagctatgaaaagggccagttcagaaacctattcagctaagatgtttcggctagcgccttcgcacggtcaccttgtattttcaccttttgagttgccttcacctggaccaaggttggcagcatttgtgattcaaagaaaagatgcccagggaaactgactctagattatggaaataaacattgtcttcaagggatagccagcaacatcaggctcagggctagtgaatcccaagccacagtgcccaggtaactctgatgtagcaggactaaagctgtctacctagtgagagctcctgaaagagaaaccccgcagcaaatctagacgttatcccttgtttctgtaaagtgagaaattgcagctatccatgacgctttatttgccagtaataatacagtttgccttacgagtggtagcttgttcactgttcaacaaatgtattttaatcatagcaggaattaagggtgatttgtgaccaggtgctgaactagaatttctcaatgacaaccccagcttcataggcctctttccattccaggcataaatatggaggctccaatgtgaaacccggggtccttctgttccaaaaggggctagaaataaaagacaggaggggaggcaagaaggacctggagaggctgacgccatttgggtgccaaacatcctatttccttggctctcccttgcacaagttcctggacaaagtaaattataacacaaaatccacaacattcagcacatgttttcattaagcaactttagtcactaaaaaaagtgcaaatgcagactcctgtataaatctgatttgccatgctaggccaagcttattttattacatacattctgcattctaagaactaataacttcatattgtaaacattaagcatacagagttaaaattcaaggccacattatatcgattgtctcttttgtcgtgtgtctttggctggccgagatcaactcgtagtgtataaatgcataagttatataattattatataaaaagggggaaaaacattgacttgtatacttcattctgacaaacgcacagcgttcgcgactcaaaggaaaactggaggccgcctacccaaaatgcctgcgtgatttctgattgtggcagccaagaaggccatctcttacctgaccctgtggagaacaaagcccccacataatgatgaggtcctgaatgtttctcttaaatatcagacaattccagttaaaattttcatttgacaaacaaagaaagagatgcgcatttttgtttctgaattctactacttcccctttctccattacgctgtgtcctttctcctaacactgggtttggtataacactgactgcatgaaccctcgagtctccataactcattgtacacagtccccaaatgtcctgagtccagtcttcattgcttgagaagtttctttcccagccctggtctcctccttctctgcctcttcctcctccttcttcacccctctgtctacaatcacacgctcactctatacacatcctcagtcccaccttttagttcatagtcccggtaatactgtaaaggagttggaaactttgggtcatcttcacagtttgagaaagctgacagctgtccatcaaacggaatgtatttgatttcaaccaaaacagcacatgccatgcagttgcatatcaacgtctgttgatgggccacagtctctctcgtgtcttttctcttgtttttgatatgtttctatttttaaatacaggtagttttccttaaaatggcattataaacggtatgttaggtcaaaactgtgttgtttctattgctttagtttcatcccagtttgcattagtgggattccaaactctactctaaagtttatacatttcttaagaccactttctttggcactttgtccttaagacttcatgcttctacatacactgtcttttacaaggtcagtccacagatgatatgtccatattcgtgacatttttagcatcctcctcatttctgtagtaagacttcagtaactccctcccaagagtctttggatctcttccccggcttccttccccagccccagtaaagcttttttcattcctcttgaggcacttttgattcatgttctccgatagagtttgtggcgatgggctggtgaatgcacgctgatgggaaaagcctccgccaggtctttagtagtaagtgcccagatgagaaggcatatggctggtggggagcctagtgttggggtatatacccccagttggtgaattccagtatgggtttggggcagcaaaaaaactggaagatgtcacggggagggctggagggtggggcgccacaaagttcatcttctgtgggtgggcgtgataggagcccatgtacgggaggtctgaggggtacttgtacagagatgactccggggggtggggctggagggcctgggcgatcccgtggaagtcgaacttgtaggcgtagcgcttcccatggaccttggtcatgatgttcttgtcatagtagtaacggagggcgcggctgagcttatcgtagttcatgttgggtttgctcttccgctctccccagcgccgggccacctcgtcgggatccgtcatcttgaactccccgttggtgccttcccaggtgatgcagctggagttggagctgtccgacaggagctccaggaggaactgccaaagctggatctggccactgcctaatgaggtcaggagaggaaggaaaactccagtgagcacaggttccaggggaaagaggctctctgtgatgacggaaggaggtgctattggtgtgccgcccacattcccttcaccaggcctgtccgtccatccctcagctgcaggggtgcggactgctctcgttccatggccacccacttctccagagaactgcccttgcctgaacagagccgccgcctcgcccacccccaggtatcccacagctgggtggactgaacggggtaccacgggccggcccccttgcctcaaggaaagaccaactccatgacgctattcaggcttcagggctcccgtgggattgggctgaaacagcgtccagctgcaaggaggcttggaggaggccagaaacttccttagcgctgcccctgcagcacttcccattctctctctcctgagaacatgccgttaatcagtcacctgcacaagcaggcttaccccaagctctgcatcaagggaacccgacctaggacgatgatctaacagattcaagacctagatggaatgcagcgaattcatatggggcaaagttcaggctgcttccatccatttctgacgtccttaaaagaacagccagatcaacctggtgtttaggggatgaaagagctatatatttttttttcctattttgtgaagcacaaagtactgttatgtggatggcaataatgacttaatgccatttatattggctaggtcaagtaagataataaaagttagatttaggaaatgaacttctaaaagtttatggaaaaaaatcgagaatggaagtaaacaccattatttctaacataacattttgctggcgctcagaaagcaattctgtgaaaacttttcctagaacagaattaacccactcaaaatgaggaagtttaggaaaaaaaaaaaaaaagctggctctttttcaaaccagatcacccagttccagtatttgggcaagcgcatcgtaacggaaaccagtgccttgcctgtgtgctgcaacgccaattgtgttaagcagcatttccagaagaaaaaccccaacaatgagtgattgcaagtccccttgggaagctgaatgagactcttcctttgtcaaagagatcacatttagctgggtggacaaagtcagaattttcttgatttcattgaaatcatacagatacagctttgttttatgaaattcaaagaaaaatctaggcacatcattctagctgctatgttacaatacttgaagatagtttatggctccctagaagacagcagcatgtaaatattgacagcagtatccgtaccaagagaagctaagctgtgctgaacatatttcagaagcttaagaacagatgggaggtgggtctttcctcccaaattccagttacagcactgccttagacttattaccaaaagattaccttttattatagtgtaagtaatatcaatcgatgtgataaaatgattaaagtaactttaactgacatctactcagggaagtaatatactgtaaaaatcaattttacgttcattttcttctaaatcctcgctagcctcctgtacatatcacccaacttataaactctgctttgcatgttggctacatggacatggatatttttgtgaatttatccatacaatagcactgtgagaaaggtcagctttttctgaatctatgctggaaagtgctcattttcagtctagcaacacatttgaaatgtattaacagcttgtagctcattgaagtggaagcctttgctttttcagaaccacatatacaaactgttcccaatcaagttttgttgcctccaacattttattaatatgcatttagaaaatacaaagaatggtatgagaaaaccatatggtcttagtatatatattgtaaccaaaaaattacaacttgaaaaaattccgtatatgacctgggaataggaaaaggcatggatttttgatttaacagtctaacagatgcttcaatataaacacatacggttgtttgaaaataaatattcagcgtcaactttctcccatagagaaagcaactccacagacctgccgaaatcacacttggaatctactcaaaccttggcattgcctcttagcaatttgtccctcacccatttctcttataaacgtgtgtaggacagaatcagtggacaaaagtgatctcatgtctctcctatttctgaagagttagaaagcaggggacctaaatttgtggcagcaaactctatgcccaaaggatggatgagctaatttctcacttgactattttacccagtagccataaagacatagggctcaggactgtgagaatttcaagggagggtctatagaaataagagaactgtaagcaaaattcatcagctttcaaaccttgaaagaaacctggaaatgcaaaatcaatgaatgtttaagtaaatggtagaaagagtaacatcatgtcaaactcattaattgttaaatttaatatttgtaacaaaattcgctgcattttgcagtgtgtagaacaaaatttctcactgcaagaattctcaaaaatgaacaatggttgttaaaaaattgtcagtggtaaaggaattattctcagtcataaaattttaagagcaatttttaaattcttattttacttccaaaacaataacatttaatgtgtgacgaggtgcattttagaatatagaatagagatttccaaacaagaatgcttagggtttaggaaagcctaaaagtggcttgggtcactcatgggccaaaccaggatttacaaagagaagttcttgaaagacaagagctttcattgagtagcatcaccacctctaccttaggactcacctttcttgggtaaacccttcagatctattttttttttttactctctcttaataacatccttgcgatgtcagtaaggaggaactaattttttcttagggtaattaccaaaataaaacatatttggaggtaaaaaacagtggcaagcagcattgtccacctacagagaaccctgtgggtgaaagggagcggctgtggcttttaagaagacagaggcactcctttaattttacagaggaaagtaatctcctaatattgttaaaagaaagggagagaaacagggtagcaaaggggtacagactgagcaaaaaagggggaaaaaaaaactaaacggtttacaaaccacagagcaaagcagagagctgcagagtgagtcagcagctgtgtctggtggaaacagcatcctggtgcaaagccctgcagccgtcagctgatgaacaagggcagtaaatacagccgtgaggggccccaccagtaccatgtggcagtggtttggggccactttctctagaagccaggggtggtgcagaagatcccgtgtgcatggcctggaccctctgcaaggcagcaggtgtgtccagcaggtgtgtcctgaatggaagtctctgccccgaggctcagtgaggctcaggcaccacttactggaggggcaggaaagcatggtggtagggagcaccaactttggagttgccactgcttcagctgaatcctgcctctgccctttgtgggacgtttggcaactctcgcagctctctctgcctcagtatcgtcatctgtaaagtgggggtgatggtaatagtactatcttgcaagatcatggtaaggatgaactcagtacttgaatggtcttgtcagaatttctttgggctgaaaatcagagtttaaggaaagataacactcctctcctatagccaggaaatgcctaaagaaagagaaatactgttcaattggcctattgaaccatgaagaagcttgaaacggtgctattcttgggctgactgatatcctctgaaagcttactgtgtgccatgcaccattctaaacgctttacatgtattggtttatttaatccccacaggaatcatgtgattagtccattggagaagtgacgaaattggagcttagagaggtagactgacttattttgcttagcgttggcaagggttgaaatccagactctaggctgccatgcttaatcactgcgcaaacttgctttcaggcctggtttatgcacacctctgtagcctcctcaggtcctttccatgttgtcccctccctgggggactcccactggaagactgcacactgccacctcctaacaaatgggaaaacatccctagcctggtctgtcgttctgcaagaggcaggatgtattttcatgtgcaccattgaagagtatccagttagcatcaaggaagcctctgaacataacccaccaaagctctttcattagaggaaccatgttagatagattctcagctgctctgatgggatgtaaaggagctgtgttgcttataaccgatccatgatatcagaatgcagggacacactgttctcagcaggaaaagtgatgtccaaagtacacatcaagtgaatatttgggatagagatgttgggatgctgacatcatcctgtgcattcatactatatgatgcaatctttccacttaaaatgatgaaaaggaatttgtattgtatgaagagcaaagacagcaatttttaagtgatgaaagatttatttatcagagaatagaaaaatagaatcaaacaggaagaagcattgtcattaatacaaagataaaagacattctggtttcaggggaaaagttcacatgagcacaacagacacaaacctaaagatagatggagagaaagtcaaattcatcagaaactaaatgaaataaatctttatcttaaagtcacttgcctgcaaatcaaagatgggatgttgccattttctccaggcccattaagaacagtcttaatggtatgaagcacagtcctccttccccaggcctgtgatgagtttccggtctccttgctctgagctcaggtccctctatctacaaagggcatccccgggctgctgggcccagggcatatgcagtgttcccttgtgaaagctggcactttgcttaggagcaagtgactcaggccctattctacaaacaagccaagcagtacctttgggctgtgacaacgtggtcatggacatatatgtttcatttggccaatgtgtgagtgcaaaggccagtttggtcttctttggtgcagcttgactctttcctcctcttccttcctgacctcagattcatcgcctgcacctaagcagttatgaccctgaaaggaaatccttgctttctattctcacagtccgcattttgtaagacctcctcttcccttcatacttagtcagtggcagagtagggcaagaaaacaaaagtagactttgcagacagagtcaggtttctaacctgacctcccttatcattggctgtgtgacacaggaaaagttacttaacttctctggacttctaattccttttctgtaggatggagatagtaacctcccagggctgttatgagacacagaagggaccacagacattctatggggggcattctgcgggatgggagctgtttgattgttatttcacatgattgtattaacattcccagagtgtttcagcttccgtcattttcttttttctaatctatcctgaacattgctgccagatcagtcttcctgaagcatgactgataataatcatctcaaaacatagtcattatttttatttgaatggttatatggcagagttgcaaatgaaaagctgagcagaaggctgagaagagaccacagcctcaggagcctgggctactagatgaaagccagcatgagcaaaaagggcctgtggctctgtgtttgggacaatgttgtaactacctgtgtccatctctccacggaccaaaagcaccctgagctaaaggactatatctcattatccttggcattcatgtatgcaacaaataattattgagcacctagtctaggccccaggctaactagttttctttagattttcagctgtgtaaaaaaaattcattgaattcattaacattaaccaaaatttaacttcaaaaatacagatgttcaataatgataacatttcgtgttttcaatgtgtagattctcttgcagggatgtacactgattaaatcttaattattccatttcgaaccttattttggcctcaacgtttaggaaatacacattccatcttgtgcttgcaatatgcctgtaacatcttggcatttgaatttgcagttgggaatatgcagcataggctatgaatttctgaagctggtgccagcacagctggttctgatctgaatacaaacaaataaaactatgtggttggcactgaaacactaggacaggtgacaaaccttggcaatgcactggttacaaatgggctaattaagaatctgcactttcttctagcatcgaagttcagaaacagaccatcgaagatgagcctgaatttgaagtcttgtggttgtatcaaggctctcttttaaaaaatactagttattttatctgcttgtataatgggttgaattgtgttccctcaattccctatgttgaaatcttaacccgcagtatctaagaatgtgaccttttttggagataagatcctaaatgaggtaatcaagttatagtaaggttatggggtaggtattccaacctgaccaatgtccttatgcaaaagaggcatttggacacagagactgacacacacagagagatgatgatgagaagagacacgaggagatgatggctatctgtaagccagggagagcccccaggacagatccctccctcacagccctgagaaggaacgaaacctgccaccatgacactctgatttcagacttccagcctccagaactgcgagacaataaactgttgttgtttaagccacctaatccgtggtactttgttacagcagccctagaaaactattacagcttggattaggttataatgttctttgctgaagctgaaatcttaatttataacccaacccatctttccattaaggcaaataattcagtgagacctaaaactaaaatctgttcagttgaaggaatttctcaccaataccaatttacttttcaaaataaccactgccaaaaagtaattttgtaagaagaaaatcatcagcagtttctcacctggatttgcaaggcggctacttgttggtccaagaatctgataaggatctacagcaaaaagaaacaaagtcaaatcctagacatagttgtaacatagtatgatgtgacttcagacataatgcctgacttaattgttttttcagatttcagagccgaaaatgtcctccaactccaaatcaactgcctccacctcctctatgagagaagatgtcacacggcatctcagatgtcttgctaggggactcctaattggtggcagggcttggattcaaccccaggatcctgacatatagctcaaggctcacaccaaccaatgatataaagagggcaaacatgtgccaagccccatcaatccagggccgtgcaggctgtgttgtttaggcatggaaagtaaaatctaaaaaattaatggatcacaaagaagcagcctgtgtgcacgtagaatttttttccctatttattgcatagttggggacgtgttttagcaccatctcaagtcacctcgcatgagtaggctgatgacttgggccctatcttatgtatggagctgtcgaaaagaggcaaacaatcatgttaatttccattaaaaagtgaagcattttagaaatgtgctgctgagcctgaatcttctcttatggttatccagacggcccctgaaacatacctaactgaggacgctggtcttcagttttgggcactgtggaaggagatggttgagcagctgaaaatccagaaatacaaaaggcaattagctataacagatttggtcactagtctttgatgttgttgcataatcattctatcagttaatttagttattaacataatagtctaactcagaagcatctcacggtaaggaaaaattttcctttctgatgaaatcaaatgtaaacactgtaacaaaaaaagaggacatttccaattatttaaaaaatggatacctcccactttttccaaaagtaaaaaaaaaaaagaatttggaatggcttaccaaacagattacaataaatcatagtctaagataaacacataaagggaaaccaccagtcaaataaagtaaagccagggatacttttaagcatggccaagattcaggaaaacaccgattatttaatgtgtactcaaacatcccatgaaacatgcatttgtgaaggttgacatacactacatcattcctttatttttgttatgaaagtcctgatgacccaaatggagaaagaatcactgcagtgaaagatcaattgtactcttgtcgtcaatggaacaaacccatcacatgttgcaaaatcacagattaaccacagaaattattatatactccatcaacagtcatccactgcctgtgacatgaaactcagggtcatgggagccaacactgtacctttcgactggggcgtggggtggccgtgaccggtccaggctgatctcctggggggctcatatggtaaatctgtaaagacaaataaattgactaaaagatcaatcatgtaatttttataagagatgctttggttttttatttgattttgtatttattagaataaactttgtgcaaaaaaatctggtaatccaaagaaatatcccactagatttgagttttatttacaaattaaaatttcatatattatagtggtctaaaattctcacccgtttgtctgaaaacttccattggcagattctcccagagctttccaactcttctaatttcctacaaccataagtcaagaccccaataaaagtttcttacaatctagttcatcctgcttccactgggactgatctacatctgtctctttattatcttcatgactcatccaaagcagagtctacaacttggatgaaccagcccatttttgtttgaggtctgttcctaaatcaatcaaatgacattcagcttctttttcttcttgcatctcctgggaagtgatcgctgccttatctttttatttgccagctgcctctcttagccaactcccattttccctttataatctcatcaatttatattaaatcagtcttatctgatctagtgattttcataggcaaatgtctcccatttctaatgttctaaataaatttagaatttctctaaaatgacctgcatgaaatgaattacaggactgaaatagtattgctcccacagcccattaatgatgaccttctgagcttaagcatatgccaaacatttctttgtatttataaagtcgtatcacttgtcctataaaccttcatttacttttcatatgcaaatttaataactatacttctgcatcctcagtgtgagttctattaatgattatcaaagctctatgtcatttcaagtttgtttcaaaaatatattacagaaaccttattataatactcttgctaagagtgcatagctaaggctatttctacatgcaatcttattacataactgtttcaaaattatgtcttcttggattgcttggtctcagttcaatgtcatgtgtcattctgggccaagtgaaggccatggccaaatatctcagcaggtactttgctgccagacaccaggagatgtgtacaaaatttcacttggagggtaggacaatgcaattgtttttaagcttctctttaaacaaatattttaattttgtttaaaaccagcaatttgatgggtcaatcttcaaagagcttgactgtgttgcagaagatgtgtctcttcctattttcatatcccaaagagaatagaaatgatgcgcaacgtgaaagtcaacacagaatctccttaatgtatttggtctgtttggctgcaagcatctttgctactagtgtggtctatgaaatcctacccttcagagctttggagaattagataatttttctttttaaactgatgttactcctctctctcagctggcatttttgcatttttggacgtaaatcttttcccacccagatcctcagattttcacatctcttgtgttggggttacacataggaattatatctgcagcccctaacaatttacaactgaacttcaacttaagtctctgggaacactctgcacatgggttctcagtcagttgcattttgtctaaaataaactggacagccagagtttcaatttgcaaattgtctcagaaagaaaaacctactcacaaggcaatcctagccacatctaacctaatttaggagcagaaaagcacattaactaaggccttctatttaccaaatgaaaaaaagcaagataatacagaaatacagaaatatgttctagatctctgtttctcaaagggtggtctgtggaccagcaacatcaacaatacctggtagcttgctagaaatgcagaatcttaccccagacctactgcatcaaaatcagcattttgtttattatctttttttttttttggaggtggagtctcgctctgtcccccaggctggagtgcagtggcgcgatctcggctcactgcaagctccacctcccaggttcacaccattctcctgcctcagcctcctgagtagctgggactacaggtgcctgccaccatgcctggctaatttttcgtatttttagtagagacagggtctcatgctgttagccaggatggtctcgctctcctgaccccgtgatccgcccgcctcagcctcctaaagtgctgggattacaggcgtgagccaccgcgcctggcctcagaatcagcattttaacaagatcctgggtgactctggtgcacactgaagtctgagaaagcctgctctagaccattgctcttttcaggaactctgttcctgcagatgatttcagaaatgctatctagagtgtgcaaagacaaactaaaaaatggttgaaagagttctagatggattgcttttacccatggcataagtatgctaatggaatgaatagacagcatcagtaggttagtcagatactaccttaaacataaaattgttgctcatgaaatgtgactgggaaaaaaaataaatgccgaactactattcccaaaatattttgaaactctttattcacaaaatccttcatatggtgtataaccatatcccatcctccctcgaaaataagtcgaaacttaacaccaaacagtctacttttcagccaagtatttgagacagttatatgaacaatgattcacatgttcataaacatattgccgcggaagataagtgggcttttgttttcttccatgacattctggtccaatgcttccttatcggctaccgatcacatgctgtgggcactaagtatccccctgtgggatatgacattgggaaacattcaactcaggctcactgagatgggggacagccaggggtgacttctttggcagctacaccatctcaaaaccttcgtagttctgctcttgactgcttgaaaaatcactcctctatgtatctttgctatgtgtcctttattgataatagagcatcagacttccaataagaatatattttacatttaattttcgctgatcatttcaacaccctctccatttctctttgactttgatcttcaaggcaatgaactcatatgcttggcagaagtgcccatgtaagggaaggctgctttctggcactggttctgttgttttatctgtaagagactgtgtttaaaaactgagctttatagaagtcattgcataggcagcttgggtgaacacagatgtacattacatcacaacagtataaaaaacagcatgaagctacaaatagggactcggctagtgctgaccactacacaccagcaactgtgtcgatttcctgggagctgggatcagcttctcattctgaatgagactcctcctccaccacacccttttgaagacatcactaaattaatacaacattctggctaccctttcctggagggctaagttcagccaagttttacattctcccttcatcaaactcactgaggaggaacgctctagctcttgccccacacaccccacaccgccaccccgctgcctacccgctttattttttaaagggcaagaatgtggatcgtggaagagctcatcctcattctgcaggatccacaccatatctgcaaagcaactctggaggttccctggctgggctggatgggaacagatgagatttgcctgctcttgaaattagatgctaatggggaacacaaattaggaagagcaagagctgctgctaagaaccaatctagaagtgtctgtgaaatgaaaaaaaaagtttgagtcaaccttaacataattaagttgctctctattttcctccagatcttcttaaaattctacatcaaagtttgagcatggagttttggaaacattttgcattcccttcttgcctaggtttgcatatccctgtggttatataagaactaagcggaagcaaagaatgcaattttagccatttgctaagatacaggctttacataacacctaactgagagatgctatgcagtagttgtattgtctcactatgcctagctgtgctgaaaagcactaggctgtgagctccaatggaggaataatttaagattccaagaaacccctgaagagcagcagcttcaaagtagaagcaaaggctgcatttgcaggcttaactctctaatctcttttgataacaccccagaggcatatcataatatatgggttgtcatggggatggaagaggaaaggatggggttgcagaacatcatccttgggatagaactgagcttttgcatgacctgctcctaagaggacaggcagggtggtgcactgtgtagttaataggggcttgcaagattctgtggatctgtttttgccactttttcccctgagacctcaaagggctatggctccaaaagaagtggattcagcaaaaaagaagggtgtttgtagaggaggtacagaaagggattctggtcgtagtaactgcaacaacgtgagaaacacgtgaaacatcataaaataaagtataataaaatatatatatatttaaaaaatcataaaaccacagaatgtaaaatgatatgcctatgggttgatactttatgagagtagagaagactgtctcaatgctaattcaacaaaggggttgtgaaagaaggtaaatcttgaatcaggaaaacgtgggaaaatactaggtacgggcatgcaaggaaaagggatgaggtttggacaaatggcaggtagtggtggtggcagggcatgttcacatgtggtcccctgtgaggtcagtgaacggcctcggccaattgtgcagggagactgaactgacacagcagcagcgagactgacctgacagggaagcagtcagggggctctggaataaatgatccacttgggaaggtgggccatgaacagaagaaaaggtagattgggggctgggcatggtggttcacgcctgtaatcccagcactttgggaggcagaggtgggcggatcacgaggtcaagagatcaagaccatcctgaccaatatggtgaaaccctatctctactaaaaatacaaaaattagctgggcatgatggcatgcgcctgtagccccagctactcgggaggctgaggcagaagaatcacttgaactcgggaggcagaggttgtggtgagccgagattgcaccactgcacttcagcctggcaacagagtgagactccatctcaaaaaaaaaaaaaaaaaaaaaagaagagaaaagaagataaaagaaaagaaaaggtaggttggggcagtaacccagggatgggtgactcacagtgggaagggaaggagggaagggtggtgaggaagtgctgggaaggtggatgcagcaggacaacacacatgtgtaggagtctctgcagaaagggtgcggaatgctgtctaatttaaccagtaaaccctgaacaccactgtctcctctatcagggactctataatgaaacggccaccatgcagagaagagacagattctggtctaagtagagttgttacctaggagcctggcttgcttcatggtcagcacaataacgctgaccagagttcggttccctcggatgtgggattagacaaagggtatggaaatgaagatcatggcacagcaaaccaagagtggaggagacagggatttgggtctgtatccccaaggaccttcaaagaaacagtcaacaatcacctttctgaaagtagtcaggtacccactgaccacagggatatcgtcagattcccagtgacctccctctggagctcgttcagctctgaaagttagtgatgcaaaagctcttccccctcagccatcacgacgttcattctccagttgcaggttcacagcttttatctccacaggagcagtcctttaaggttgatcgcttagcaatggatgacccgaggtgtataactagttcttatctccaagttcaagtccctgaatagggcctacagtaaatagtcctctggcttgttcagtctgctttaaattctttacaggtcagataccaatatttgtattggttctcataatcacagtagcagtggtcaaaacaggttatttcaggtacaaactgagtcgcgaaaacatacttgactagtagtggagctgtggaagtgtgctctctcccaggtcacgctcaaattatgggcccatggaagaccaccatcagagcggcatgggaggtgtctgagtttgccacccttgccttccctgggttgggcagagagggagtcccaaccaacatcctcacagtcaccctcttctccatccacctggatgggccataccttccaaatccaccatatcctaaaatgtgaaaacaaagcagctccaggacccactgtcttaaccaggtagcatcagtcagctggcttgtctgacagagagattgtgccaatgaatttggccagtgttgtgatcttttaacacagtttataatactagctcacaacccctggctttgcaactcagtcagaggcacctatgagatgtcttaacataaacaaacaaatacaaaattaaaaagtaaaaaaatttttaaaaccctagccaaatgttttggaaatagtttttatttttttagtttatatggaaatattttttaaatgctcacagaattacaaaatctctaaagcttgagtcaaacatgaatttctattttccactcgcaatacacgtggtggatgtctttaggaccaatcttgcagactctaggcactgggtcttgcccatgtttcaatggcctgtgaaatcttttacatgacagagatgacttactacctcttagtaccccttagctgctaagcctttccatcatgcttcccaggagcaagacagtaaactttttctctgacgttagagaagagaaaattgccagcctgaagtcactaggcagtaaccagggcagtgtcagtatttgaacagcctgagaagcttcctcattcattctctttagctccctgggcccccagtctttctcattagaaagaaagagtagttgccaagcctagatcttgaaccagttcgaactgagacttgtgtattccggatatgtgatagagtttaacatgaattctggaagcatgtatgaatatggagaaaccatcccaccaccctgaacacaatgtcatcagctgtgaggctggtacaatgatacctagcttatcgggctgatgtaagtcccagggagaggacaaatgctaaaggcaagctatacccttctgggaaatgccctctctccctgctcattattcgtctggcaaacatctaattcccctttgccatgtggccattcctctggaaagcatctttatgcctttcatgggggattgagttcctccccacccctgctcctacgccctgtattgctagaagtggttcctctaccataaaatctatcacattagggaaaacatttatgtgtacatatgtgtctctctggctctaggtcactctactgaaacatctagaactggaggcaaaacatttcggtttgttcaccatcataccatccgtggctggcacagaggaggcactcagcaaatgaacaaaccaagctgaatgaagaagtaaactttctgaagacaggaagcttactgaagcctggttcatctatatattcccagagtctaacaccacgcttggcactaatgggcacttgatagatgtttatttttgcatgaatggcatgtaaatttattacctaattaaatcatttggaggacaggcagtaagattcagatgtaaatactactggttgcatgcttctgctctgcaagactggcttcttgtgacatactgataatcggtcactgtgaatctggggagtgtccttgttttgtgctcttcccccgaggagggacagatccttctgttagttcaaaagtcggcctattcctaactgccaggcatccaggatgccttctttgcccatctgtctttctgaaaagctagttaaagggctaatctgctcttaattcctttagtgtggtctttgaatgaaatggtttgagtggatttagtctccaaatcaacagaggcagaataagactgtctgggactggcttcagctccgggatcagctctctttgtatcacgtgacttagggcacggatctcagcaggacatctgggatgtctctcaatgaagagatcacacaggggtgttttcgtacctggcctagttgtaattctttgcgtagcttcaggatatactgaagtatttgggaaaataaaagctgcaccccctgcagacaaaaggaaagacaaacatgtgaaggtcttttgttgtggttgtcgatctcaacatcagcgccaaatctacttttccctatgacaacaaagggaagagacctcctcaaacctgccttaacagagctccggagaaacagacaggtgcacctgtcagattctcaagatggaagtgaaacttggagccttggtgtactcctgtgccccgtttgctataaagcgttttgtgttttgattttataacttcttgatgaagccctatctgtgtccccctcaatcccacttcccactgggcaatctcgttttattaaaaaattatatggtacatgttttatttttcaacttgtataaaaacccataatatattttacagagcttttggaaagtagtatcaagcaattataagtatttagcctaagagtatatggattttattaataattaatccacatctctattcaaatgcattttccctctctctcttttgaccaaaactcatgctgttagctgagaaaattcccttttcatagttcagtccatttggaatttgttgtcttgttcattggtttcttccgtgtttaacaatagcaaaatttaatatatttggagcttttttgaaactttcactcaatggttaaagaactcataaataaatgtgaaattatcagaaaatgtgcatagctcaaaggtgtttcctaagaaggggaagtaacttcctctaagttatctgttatttctggccacaaggtcactaataggctgatgtgtgcaaccaaaattattgaaaaagtgtactaccaactcgaagcaggttttttaaaacttcagattaaaaagacaatgtgttgaatatagaagaccatgataaatgagcaatttcattgtaatactcaaaccgggactcactcacattttatattttaaaataaaatggtaaatattgggaaaattgcgtatttctatgtgagggctgatcgtgagttaactggctgacttgcaaggctttctggcacttcccgtctccctccctagcccgagtgattgtggagggtccctgcagctaacagagtggggtgagcagccggtggccatgcttccggaactctctccatcaggaaggagcagatggatgtgaaccaggaacacattcatccacagaaaacccagcctctgctgtgagcggggggcgagggaggaaggttagccaggatgaggcacggtgttaaaccctacttaggctcaggcaaaataaatacataactaagtcaaatgtagaggcaacggttagagatagaaaacaggcatttggttagtgactaatttcatattctccaaaattatagcagaggttccctctgaacaaaagctctcaaaatgttacagaaattccctcctgccttttgcaaacatacaaagtctgtaggaaaacaaatcaaatagcctaaaagtttattggaaaggaaaaagaaaattccaacttatcctagcaaatatttctttaagaataaaaatggaaaaaattaaaggaggttgctaagggcccttttatatcgaacatgcttttagtgtctacagagtcagcacagcgaatatattgggaccaacagaagaagactgtaatccggcaaatgtgagctaagttatggctaaaggcaaattctgcacgtctcctggttaaaaaggaaccctttgataatcaaagtggggtgcttgggaagcgctcagaaaaccaaagggcttcaccttcctttaggctgtggtacattcctaagtatccgaaagtattctgaatcatctacctgcgttctgtcttcctggcacgcgctgactggtttcccatgaaagcatgcaacctgtacgtaagaccctacgctcttgctgggaggcaggggcggggccagcattacctgtgtttctagcatgcattaaccgtggagagttttgtaaggctttatcaacatcatctgaagtcaaatgtggaagaggagctacaaaacaaaacaaaaagcgacatcaaaatgaaaaaaaaaagagagagagagaaagagaattacctttcttacaaaaaaaaaaaaaaaaaaagaaagaaaaagaaagaaagaaaaccgttcccccactcccacactaacatcatgggaagcttataactatttccagcaacctgctacttgttagcatgttaaaacctacatgggggcccgtctttaattcagggaagaagtggttgggatgccaggcaaagcaatggaggagaatttatccacctcactgtctgtcacactacttccttctcaccatgctggacgttgtagaaattaaagcatgcagcaaacattctggattcatgccaacatgccatccctttctgtcaggttaagccgaatcacatgatacaaagtgaaaacttcccttgttctgtgctcaggttagaatataaagtggggcttcatgtagctttagggagaataatccccctaattcctacgaaagagaagccttaatgattctatttcgattcggggtatcatggagacttaactaatgtgtgaccagttaacgcttcctttcccctttgacattccatcttcttggtcgcaggaccctggaggaggcagctgagtgttgaagtgaattttggcttctcctgagagcgctgactacttctcatcaggtgatgtggccagggtgttgctcccctaagtcatcacataccaagcatgtggctccctcggatccccagtgggaactgggcgagggcaggaggatgctgtcgacacacctggttgaaccctctgaagctcaggtcataagaaccatagccacagccatctatccttggaggaagggggagcttactctctctgaggtagtggagatgtgagagaaggatgtcggcgttgtagctgggggtgagcctctggaagtcgtccttggtcatcttgcacagttccttcccatcgatgttctggaataacaagatgttgacgtctggaaggccatattctttcaccgcccactccagccactgccgcacatggtctgtactccatagcgtaggatctgaaaggggtgggaacacattcagtcaattcctgaagccagggatcttcatcttggggtagatccccatccacgtgggatttctgaccagctgccttccacaagcacagcctccagccagcctccctggctacccaggagaacattttgggggaaagacaaaagctgcctcacatccatagatcattgtctttaaagtgaatagttctggaatcttgggattattcacatcacatgcccttgtttttgctcaatctaaagtttcctgtaggcataagattttaaaaattcttttttctcatttatgttcaattttatttatttattttaaaatgagtaagaataagaggaaacttcttttccttagaaaactactggtatatttatatatatttatatggaaataagagtaagccacacatatcaggaaggtgctaattacagatcacaacaacaacaaaaataataataacagtatttatgcaaaatactgaaaaatactgaccacagaatcggaaatgaaatatagatacaccaagactctagcccctcctatgagccagcgttcctcatagagagctgtcagttccagacttttcctgcagggtgtttggttttgcaattaaccagcacctgcaggagtggggttggtgagtggtttttgcattccacagctggccatggcgagcacaaacaccccacaggatgcaggccacgtcgtcacactccagtgctacctatgggacagggagagcagggcccgggggagaaggagcaggtgatctccaacagaaacgccagccgggatgtcctgtggtaaacaccctcagtggtagggtcttcagagtgtggtaaatggggcggctgctcccttgggccccgagccctgagagacacatgggcagggagttggagccctgagttctaatctcaccatttctccactttctggaccttgctgtgggcagctatttctcctttctgtgtctgtcccacctgtaaactaagagcactgatctcagttcccgggacaagcccttaggggtcaggcatgccaggatgttccagtcctcttgaatgaaagtcaggtgtgggagtcacattttagctaatactttcagatccttgtttgtttggtcccactaatattttaggctactcaagaatggagcatgtagtatgctgctgcaatacatttttaggtttgcagaggtaaaccgtaataatagtgagaaacagccagccagtcatacacccagagttctcttcctctccctccttccctcttccttccttcgcttctccctccctttcttcccttcagctacatagaagaaagaaattattgcaggtccagtagaatctacctttcccattccattctcctactgcaaacacctatcctgaagttagtagctagtggttagaagtaaccactatcctgaagttagtacgtgtatcactcctatacatattttaatatttttaccatttaaactacatatattgttttgtgtttttaaagttaacataaacgatatatgatttgctattggcactcaatgttataatttcaagatgtagccaaatgaattcacaaagatatactcaatcattaagcagctcttaggcctcccccatgtgaataatctcaatttatttagtgaatgtcccctgtccatctccatgcatacgcgtgaatgagtccgcattggtccagggcctggggtcctttctggaatcatctggggagactgaaaaactagtgatgcctggtctcccctgggagagtctgcttcaattaggctggagggcagttgggcatcacagttgataacagctcccccaggtgactctaatgagcagccaaggttcagatcatcttccctgggcctcactattccaagcgtggtcctccaaccgcggaagcatcagcatcacctgggagctaattagaaatgctgagtctcaggccccacccagacctgctgaaccagaatctacattttcacatgaaacctggggacacgctggccttggctgagtacctagatacgggatttctgagttacagggcacatccatcttcaacttgaccagctagcattggatgtctaccaatatttaaacacccacattctcacttaaaaatcagtgcacaggccaggcgcggtggctcacgcctgtaatcccagcactttgggaggccgaggcgggtggatcacgaggtcaggagatcgagaccatcctggctaacacagtgaaaccttgtctctactaaaaatacaaaaaaaaattagtcgggcatggtggcgggtgcctgtagtctcagctacttgggaggctgaggcaggaaaatggcatgaacccgggaggtggagcttgcagtgagccaagatcaggccactgcactccagcctgagcgacagagcgagactccatctcaaaaaaaaaaaaaaaaaaaaatcatcagtgcgcagaacctgaaaactaaagggaactctggttttgctacagagagaatatcaacaaaaactccaacggcagtgatgacagaaaagtgtacatatttatttgtcatccaaacacttggaaacatgttgttagtctgtgaaaactgaatgtagatatggaaggttaatgttatccagttcactgaagttcagatgactcttcgtcattggctgagaatttggctttcagagataaaatgtttcttttttcatgacatgtcagaattcctctttctacaaaaatggatcatactgaggtcttagggcaagttctctttacctttggttctgtgcagaggatagtttgttcagccctcacagagagaagaccccccatcctacccaagtcattccctgtaagttccatcctttgatgttagcgaaacccacctttttgttttgttttgctttgcttttaacaaaatgggaggactattttttttttaatgtaacaactgtacttcctagaaataagttcattctgggaacagactttcttctctaaatggtggaaccggatattctcaaaatgacacataaacatattgtctgaaagccactaggttcgtgttaaaatggtgaaaggagaagtttaatctctctattatcccttggtgtgccccttaattggtttcgctcatcaagacaagggttatcctggcccattcagttttcctttaagggaatcaggtgcaagaccccagagacaaagtcctcaacctgtattgtacttatctctacaagtctcactttgagttggtaaaaggctgttctggagttccggagttctgccaatatgagtataaattactacagcctttctgatgaacaacacaataatacaacaatacaacacaacaatacaatcaaacgtctttaaatatgtgcagattccctggcttaaaaattccatttctagaaatttatcctaaggaaataatagaggatgtgcgcaatgatttattgtcaaggatgttctttgtagtgttgtttataatagcaaaacattggaaacaccctaaatgtccagcaaaagagaagcagttttgtaatgcatttaggaatgttcctgtgatatttagagactaaaaattacactgttgaaatatatttattgatatgataaaatgttcaaagtagattgcattttaaagtttcaaaatattattatgatatcattgtattttgcaaagatatataaatatctgcacagaaagaaattcagagggagatacagcaaaacgtgaactgttgtcactgagggaaaggagatggggaattttagatttgtcattttcactaaactatattttctcatttttctataataaatatggaatacttgggttacaaattatttatacaaaatgtattctctatttttcaaagccaaaacatggtcttacaaaaggtatatatatatttaatgtatattatatgtatactatatatcacctatatataatatatgtgaaagtatttttataaaatactttaaatactttataaaaagtattttttaaaagtataaaaaataaaagtaaaaaaacaaaaagaaaagttaaaaaaatgaaactatgcaaagcattttataaaaagtataaaaaataaaactactaaaatactttataaaaatatttttataaaataataaaatatataatatatatagaatatatacttacatatatgctatatatactacctatatatagtatatatgtgaaagtatttttataaaattgctgtcaagagtataaaaagttaagtttcagtttcttttatattttgttaatatagactgcttcatctgaaaagagtaaaattacatgaagtcagaacactcccacatccttttagcatttgatctccacacctctgccctataaatttctaagcaaacaatggtgaaaacaaaacatggccactcggtagaagaaatgagggcattccttttctcctgagcactcgcaccactctcccagacccactccggaggtgttgcaatagaggacagtttgcaggggaaaaacccagattccccagcatgaagcacacagtcctttgttccatgggtgtcattcccaaccattccccctccaccctacatttcctgagccaatgcctccatgcctgtgccacatgccacccacagcgtgaaggactagcaccttcttgtgccctcacctacactcacgacctcctttgggcatctgtcctagatgttctcacagaggaaacacttaacaaatctctgggcagtgaagtgataacaagactgaagacctagtctctgctcacactgaactccacctccactactttggccaggcaatgatgctgcagctgtagatgatggtttttagagttcaggtcagtgcactgggtccaggctgtcaggttttggtcctaaccttttaactccatgaagagccccagtagtctctctagtctcctccacactccatggtatctcagcaaagctttatggcttctgtcacaccaggaatcaaagaaaggggctcatgagttcctatgagattcagcaggcctgtcttcctcctttcttgaccccaaccacacatgtgtaggaggaaggggaggggactacagcataagccccagccgaggcatcacctttgcctatgtttaggtgcgaccttctgccctaggtaggaacacctcttgtctccaggtagcagtgtgtttggaacctgtcatttaattttataactggacctcatttttctcttctgtaaaacaatgtggagaatttcaggacctgagaaatgactcgaataggataagaactaagatagatttaattcaagtaaaagtcattaagcattatgcatatggctatatgcaccagtactatggagattccaaagtgtccaagaccaagagaaacactaaggacccactgagagaggcagcttatgaccacaaccacaaagcagaactaagtctctgtgatcaggctgggcgtggtggctcatacctgtaatcccagcactttgggaggccaaggcgggtggatcacctgaggtgaagggtttgagaccagcctgaccaacatggagaaacctcatctctactaaaaatacaaaattagccgggtgtggtggcgcatgcctgtaatgccagctactcaggaggctgaggcaggagaattgcttgaatccaggaggcagaggttgcgataagccgagattgcgccattgcactccagaagcctgggcaacaagagcgaaactccgtctcataaaaaaaaaaaaaaaaaaaaaaagactccgtgatccaaggaggaagtggaagtgcagagaggtagcaccaaccaggaaaaatgggaaaggcttaccaggagagtgaacttggattaacagcgaggattttgacagaagtagagagaagctctttggtttaggggaaccacttagcccagcctcatccgacatgggcatgaaatatctgacatgtttaagaaaaagggagaaatttggtgtggctgcagtggaggatttcagagagagcacagcaacatacgaggatggggatgaaagctgggctcagatcaacaaggtccttgagtcttgctaacaaggttggattttcatttttagagatttcagagtaattgaaaatttctaagaaatttttaaaaatcttaaataacaccaatcacagaaaacttggtgatgaaaataaaaggctttattgggaatccaaatacccacattgggattcttattcaaccatttactggacgtaaacgtcaacctctctggaatttgttttatatttttctgtgggtaattaaatgaaatgttaggggaatagaaaagtaaatgagataatggatgtgaaagcactttgccaacaataacatactgcaaaaaaagaatgcatccacacactcgattttgcattgcaaactctgctaaaatggaataagaacaaaatctgttatcacaggggcagcctcctccttaagacacaaaagtccaatttataattttattttaagaaacttttggagatgcttctgtcagatgaatcataagccattgaagataagttgttcattttcagccttccattccaattgttttgaaaacatctgtgtcatcattctacatgtcatggacaccaaaatggtaaactgtcatggcacaggctaaacagaagccatcactctctgaagcctcttatttgtatcttaagttacatggttattatgaaatctactttggtaaattggaatttaaaaaacaaataaaagtaaaccattacacacagagttctggagttgtactgttaatgtactctgtatgtggagtgggagtgggggtataagcagtgggagggagggaggaaggctgacatttaaaaaaaatatttccatgaaacaggattctgacctagtagagttcccctgttgccaggaaaatattgagtagatatttaaatcaggcaaaggggcactgcatcgccaaagacaaactgtgcctttgtgaaacaaaatgcctcacacaggcaaacatcttctttcagaggcccctctagagaaatgaataaagtaagattaaataaaagccaaactggtgataatgaaagtcctgaatgttatttttcttaaataatatcaacgtaaaatattggcttcccaaaagaaaaaaattactcttggttatgaaaaaaacatcaaaaaataaaaactaaaatgtacctctaagccatatcacaagcctagtgaggtgtttgtttataaatccaggccctgggcaagtcagccaatctgctgtccaagacactcataagcctgcaaaaataagatttaacatcttgcatcctcaggaggacagaagttacatttataaagcaggcccaatagagagaactggcttaaatttgagcaatgattcactccatcacaaatggaaatttgatctcaaataaagagcctacctcaagactgtttctgagccttttaaatttctaacttatatgtagagttcatttattgttttggtattgatttctaattttattgcacgttggccagtgaatagagtctgtatgaaattaacattttattttattttatttttttgagatagtgtctcgctctgtcacctaggctggagagcagtggcatgatctgggctcactgcaacctctgcctcccaggttcaactgcctcagcctcccgaataggtgggattacaggcacccaccaccatcgtggctaatttttgtatttttaatagagatggggtttcaccatgttgtccaggctgatctggaactcctgaccttaggtgatccacccacctcggcctcccaaagtgctgggattgcaggcgtgagccaccatgcccagctgaaattagctttttaaaaagttccggtttgttactcttttggcggcctagtgcatggtcagtttttataaatgttccttgattgcttaagaaatgcatattctctaatttgggagtacagagttctagaaaaaaaactcttggtaaggtgtatttaattttaatgtcactgacctatcaattactgagaaatgcaaattaaaatatctcactaaattggacttgactatttctttttgcagttcattacatatttcaaggctatgttattaggtacatgtaagtttatcattattatatatttgtcatgaatttagccttttttcactatgtaatgaccctcaattatctccagttatgctttctgcctgaaagtatatttagtctgctttctatttctatttttgtcagctttttaaaaattcaattttcactagcgtatcttattctgtcaactctcaatctttgtttgtgcaagatttttttgtaaacaacccataactgattgtggagtattttttagtctagtctatcactctctgtctttaatggcaaatttggtctatctacacttattatcactgatctatctgatttttaccatcttattttgtgctttatgttaaactttcttagtccattctctatttctccttgccaagtgtctaatcagattgatctacttttcttcattcacttttttttctttgtttctgtattggttttgctctttgacattctagttctctttcctgttaatctttaaacaaaatctaagtttaattaccagtaatttagaaagcttatacttgaatcatccatctctgattttacatgacaatgttccctcatatttttactccactgaattttctactccctacttagggaggctgtggttgtcattttacagccatttctttctagatctaccctcaccttaatcaatttcattgctcccatttccttcctgtatctcactcccttcttctaggatccattttttaaattaaatcttttgttattatctgaagtgaggttcaattagcaacaaactctctttttaactccttcttttatgttcttccttaatatttaaaaagtttatttattttatactctttatccaatactttaattatttaaccttctgcttaatcatgttcattgtttctgttaaatcttggttgggggagatctctcttcagctatttttttgtaatttgcgggtggcagagtcatctttagcgggtctctatctgcaggaattctgtacagcgtaggttgaagacatgtctctccatgaagatttcgtatttacttctgccaggtttcccagattatcactagcccatgaccatttttctgtattaatttctcagccttagagttcctggcacacactgttgtgtgtatggggtggggactcgggtaatgacaggctcagttccaattctctgctttgtggaagctcaagatttcattccttgcccctagttgacctttaaaacccaaatctctgcattatagcaacctaggacaaccaggtgtcaacataagaatgtgctgctctgctctattctcacttttttccttattttagtccctaaggagttcattgcctttcttcccagttcagctgtgcatttaaaaggatgttaaactccatgcagcaattccaggtgttttgcaaaaggaatgtttctcaggtccttttatagtaacctctctattttactagaaccaagagccctctctgcatactttttacctatttactttgaatagttttcatttttaatgcagccatcatcctaactcatgttatgctttacttcattcatttattaattaatcaattgtcaaaaattacttatatgaattgtataatcctctatgaaagattcaaaaatggcaagaaagagtgcctgtcctctacttgtttgagaatctacaattctgtgtattttatttaaaaatacatgactaaattatttttgttaggctctaaacatagctttgtcattctgacacactgatttatttctctggatgaaaccattctcaagtaatcatcttgtttttggataatgatcgttattgttctttgttttcttttgttgttgttgcctcctgttattccatgacaacattgtgtgtgctcatcatgttttagaaatgcaatggcttgttccacataaaggtttctccctgcctgggttttctttctttgtcttctctttaaatgttgctatccccagagtttcatccttggtctacccctctcctctctccatatgtatctttgggcattcttatttgctctcatgtttgaactataacatgcatgctgtattattttcctagggctgccgtaaccaagtaccacaaaatgtgtggcttagaaacaacagaaattcatcgtctcatagttctggaggatcaaagtctgaaatcaaggtatcagcaaggccttgctccatccgagactgtggataaaatctgtccttggctcttctagcttctggtgctgtccagcaattgaatgttccattgcttgcagttgcatcagtccaacctctgcctgtcttcacatggagttctccctctgtgtttccatatcatcttccctctgtgtgtgtctatgtccaaatttctcctttgtgtaaggacaccagtcattttattaggctcaccctaatgacctcatcttaacttgattaaatctgcaaaacctctatttccacataaggtcacattctaaggaactgggggttaggacttcagcatatcttgtgagggaggcacaattttttaacctgtaacaggcagctgtttctgccagtctatatcttgagtccccagggcactctcacagatgccagacccaaatataaacagaagaactgcactttttatcccaggtactgtttaagcatgtcacacatattgctatatttaatccatatagcaccacatgaagtaggaattattatcatccatattttggtgatgaaaaacctgagaaacagcaagattaagtagcttcccagatcccacagttagtacatggcagagtttagaactcaagtgctgtgactcccgatcaaggactttccatcctgagctctaggcccaccacactgcctgacaggtgtcccagaagcatcttaaacacaggatgaaccaaactgaaatcacctattttaaacattttttttttgtatattcattaacacctacccagctgctcatgctaaatctaagctgtcttcaattccattcttctctttgactttcaagaaaaacagataacatcattagcactgtagaaatgtaaaaattagccctgggcaacacagtagattattttacaaaattccctctccacctcctttgtttacttaagtcttatttgaaaaggctgttgcagaatgtctacaacaatttaacaaacacattctctcatcccattcctgtgttctcccctgggtatttttgtcagcacagcttaggaagaagaacccagactgtggagtcagaaagaactgggttcgaatcctggctcttcaaatgattggctgtgacatatttggcaactctcttagcgttcctagttttagtttctttactgtcgagtgagaatgataatgagtacctacatcatagggtggtcgcatgatttaaatgagataatgccttttctacaaagtgcatgtccaagtgcctgacaacagtgcatatcaatagatagtagctgtcgttgctttttagaaaaatgacttgattttagcctcacatttaacccaatggtggtttcctcaaccgctattcagctgataactttaaaatacacataataaactttgatgttagcatttctattttagtgggttttgttatttagttgtttgagcatagcaggaatttaaacagaagattaaagaagcatgtcccatcatatcgacagagtggaagagatcctcgggtgtgttcagggacgtaacaaagaaagatgaagacacaagtcatttcaccagcaggttctgggcctgagaataggctctggtctcacccagttgtgcaagtgttcccgggaaagtcatttcacctctctcagtcttggttttctcatgtttaaaggaagactgaacttagaccaccaagaatcctgcaacccctgcgagtctgcgattcctgctagttagatctagattactgttaacttgataaatcacatttactctcctccacacagaatccaagtgctggctgtgttgtctggcgattgagaacacaaaagacatgatcatcacctcactaaacttacaatctaatagaacagacaggcttataaataactcacgctaagaggattggaaacataatatatcagccatcagggcttggtcggagggtatgttctattacttgttattcactggctttcaaagcccagtgggggaatgtcaatatttagggaggatcatgtggaaactatgcagtcctctaacactctgagaactcaagatcccttctttacatgaaatcagactgccaaagactcatgctgggtgtctgtcctctacctgtgctgagctattctctaatgtaactcagcgctcacagaagatgtcacaagaaataagctgttgaaatgcagtgctgcaactgtggcaggaagacggtcgatggtcaggtctatggccccagtggccccaaaagggatccttcttttaggattctacactatgataaacattgccttccctgtgaaacttcttttttgaaaggaaaaattatttccccaaataactcttttcattttggctgccaggaagctcaaagccatactagaaacttaagtacagcatcttgggcaagcttgtggtcaaaatggctgcattcttccctcacatgctcttggcttctcatttgtatttttaactgccttagcactgattcctaatttccatttgataagtcaattgggtataagcccatcagtagtttagttcacacggcacctcaaatcctttgcagaatatccacatttaagtaagtatatacatgcatttgagaatacaatatgaaacaaaataaagtatgataacaaaataattggtaagatgtcataagaggagtgattaatttgccagaggatcaagcatggctcccttgacagggcagattttgaagatgtctggaagaatgagcaagagcattccagagagggaaccgcagggacaaggacaccgggtggtgaaaatgcagcgcgtgagttggggatgtggcagaggaaaacggcagaggctgcaaagggctttcgaaatcacatcatcgtgggtataaatgaagctgttcttgattcgtcctgtcatagcaatctccattcctcacatgctctgaaatactggtctgagtcattcatttgagctctcaatcacaccttctcctgtctgtcaaaaactacttaccccacatgggtgggtcttagctacttctgacagccttcggtcatctcctcagtgattaagagtaatgggaactccatgaacactttctaacggaatagaaaggtcctagcacaggggtctgagtaagacacaagtcatgtagcttcagccacacatgtttggtgggcaagaaaaggtgattttaaatctcattagagcttttattcacggtgaatggaacacagtaagagtttaatgaatgaattaataatgaagaaagtgaagagatacagtgaagagaagaatgtggctactcttatctctgagattactgattattgcaagggtctatgctgaaagtgaattattttaaaaatagaagcagaggcatttgaaaaactcaacactttagcacctattttaaggaattaaaacagaaaaagaggccaggcccggtggctcacgcctgtaatcccagcactttgggtgaccgaggtgggtggatcatctgaggtcaggagtttgagaccagccttgccaacatggtgaaaccccgtctctactacaaatacaaaaattagctggctgtggtggcaggcgcctgagatcccagctactcaggaggctgaggcaggagaattgcttgaacccaggagacagaggttgcagtaagccgtgaccgcgccattgcactccagcctgggcaacagagcgaggctccatctcaaaataaataaataaataaaaaataataataaaaaaacagaaaaagagaaatctttcaaaatgctataagctgctaaagcgagaggtcctattgcattttggtcagcattttgcaacttttaagaagtgaatggagcctgtgccttcctctttgttagccacttggttagcacatctccatgttcacagccaacacctaaagagtaacagtaactactgcaatgagtgattcttcatttttttttggaatgttaatgtgatactgttaatcatttctatctttcctttttgtctacttgccttttctaaaagtgataaaccatatctttattaaaaataattcaagtctattaaagtaaaatttatatcttctatctagattagaacttttcaaccttattgtacatgaaaattacatacacaataagcatgttaataatgtaaaatttccaaccccacacccaggtttggaacatttggaagtgtgtgtgtgtgtgtgtgtgtgtgtgtgtgtctgggaaagggtctcactctggcttcctggtgggagtgaagtggtgcaatcatggttcactgcagcctcaaacttctgggctcaaagaatcctcccgcctcagtctcccaagtagctgggactacaggaaccaccactacacctggctaatgttaaaattttttgtagaaatggggtcccactatgttgtccaggctggtcttgaactccttggcctcccaaagtgctgggattacaggtgtaagccactgtgactggcaggaaatgtgtatttttaatcataaattttccaggtaatcttgatacaagtggttctgaccatactttgaaaaacactttctaggccaggcgtggtggttcatgcctgtaatcccagcactttgggaggccgaggtgggcggatcacctgaggtcaggagtttgagaccagcctggcaaacatggcgaaaccccatctctactaaaaatacaaaaattagcctggcgtggtggcgggcgcctgtaatcccagctactcaggaggctgaggcaggagaatcacttgaacctgggaggcagaggttgcagtgagctgagatcctgccattgcaattcagtctggggaacaagagcgagactttgtctcaaaaaaaaaaaaaaaaaaaaaaagaaagaaagaaaaagaaaaacactttctagtcaacctccaaattaagctcggccaaaaaagagccatgtaaccagcatgggggatgtcacacttgtcaggcccctcttattacaactggtttcactgaatgacacttgggtttacgacagtgtaagagactgccctgccctatgagagatcctcctagatttacagatactcgcaccaaatacatagataaaaaccagagatgggaattatggcctaaccagtaccctttgggaaggcacaatcaacagtcttgccagaacaacaggcacaaaccagggctgcccagaatgcctggtggcgctactggttgaatgctttgctcatgactccccttatcttccttaggacaaacagaggaacacatcttcctccagactcagaattaatagctggaccatcttttcacatttgctttctttttatcctgtaggcactgaattatccctttcatactgcctgatgatacctcgaagccaaataacacctaccttttgcaattctgcaatatttaaatgttgcaattaaaaatacacatacacacacacacacgtgcgtgtaaacctcactcctggttttactctctctgttcaatttttactttagtccattctccacattcctttatttttaaaaagtggattctaccgtgctctttcatatgtatctatgtgagctttcttaaatctgttctgaaataggaggcagtgtaaatatatcaagtgacagtctacatttatccttcagggacattttctagttgacactttcttatgggcttttttttgacactttttttatgggcttctttattaactcaagatcatgagtatcaaaaccagggttgagggaatcgcttctcaaaagtgggttccaggtaccagaacccaatctgaacacggacaaagccccccagctcctctgtggttttatctctcagtctccgtacagtacaaatttcctcatcagtgtttattagggccactgctatctctagtgtgtaaacatcggcatgtattgatgatggtacaaatgtttaggaataactgatggtttttttttttttcactcagctatccgtgtgatttgcattagtgccaagcaatgtctctaagtagtaaggtctatgtgaaccactcaggaccaggtctggagaattctttttgcacacatggggtactccgtgccccaaatctgccttagtgaggtgcctggataccatggggatggatacagcagctggtacagctgcctgaggtcctgcaacctcatggccacattggaaaattgtccagattgtgcaatgaagctgtgtgtgtgtgtgcgtgtgtgtgtgtgtgtgttcatctctgtgtgtgtatgagcacacatacatgaagcttgaccaataactgaaagactcacaacttgcaaaatcagccacaactagctctcttacaaacactattaactgaataactgcctacactggcgtgaagcaactgaaggagggaagagctgaagagaagagtactttgctccaaagaaaggaaacagccttcacatcaaagcttactataagccaatttgcagagctatccttgcatccatccagctaatatttgatgagcagctactatgtataaaaaatcctgggtgctctgacttcagttgattctctgttctcttccccacacaaatatctctcttattttctaaatactttccttagtgtagaaagactcaagtctggccctactgaaaaggatatttatgacatcaaagcatattgatggcctcatggaaatacagcctcaccagttagaagatggtaccaggcattacctcttacatctgtgattcaatgaggaaccaagcaaggaatcttcagtgcaggccccctcagatggattctctcatctttgagatctaaacactttgttttgtctcctttgaagaaattacattcttaaggaggagggcaaagggtgagatgggttagggggcttcctttgggtgtctacttcactttgttcatgcccagagagtgtctgggcaacacaccactgccctcctgcctctcctccaggcacatcctagccttcgagtttttcttatgtgccacacatctggagtgggcacctgggacatttgtgtttctatttttcccatccaacaggaacagccccctgttctgaggcacagcagcaagtgaggcagtctcaggcattcaggtgcattgtcaagatcaaaccaaatgcatggcctctgtacctgtcaactgcctttcagtaaatactaaggacggttttctccctttcgtaatctaccatcagtgtctcctgtaagtcttaaaaaatgctttgaaatcaggcacaaccccaaaggatggtccctttcacaccccactgcatcgaaccagctttacgtgtttgctgaaagtcacatggtgacagatctaagctgaaacctgggattcaaatccaggccagatgttttgcaaagtaccctgcactcctgaactcttctgtctagaaggtgacagaagcccactgggcatgatccaactcaggtaaagggaaagtcacaccatggagggaatctaacctgtttgccatcacacttcgcagatattaatttaggtgaccccaggagcaagggagaattgagtttgtgcagatttcacccatgcatgcccttggctactttgccaacaaggagtaacttgtacagtgcagctcagtggtgaggtgtccgttcatccattctccacctcccttaatattcactgagcacctcccacttaccaggcactgcaactggccctggagatagggcctttgtggggcttatgttccattcagggaagaggataataagaaaactttttatttttttatttttattattttgagacggagtcttgctcttgtcgcccaggctggagtgcaatggcacaattttggctcactgcaacctctgcctctctggttcaagcgattctcctgcctcagcctcccaaagtgctgggattacaggtgtgagccaccatggctggccagtaagaaaacttttacataaacatgcaatataatggcagaagggaatgaatgaaatcaagaaaaatcaggccaacaggagactggcagtcacaggtggagacgagagcaattccagacggaagtgctcaggactggcctccctgaggccatgacattggcacggatacttggtgaaggaaaatgatatggaactacctggaattaagggtttcaggctgagctgacgccaaattcaaatccctgaggcaggaccgcagggtgaccagatggctgaaacaagtaacaggagggaacccacagaaattgctgtaagcagctgagatttaatccaatgccaacaggcagagactaaaggagtaaggcagacctgcctgagtcctaacttggcctcttattagcctaatgcccttggaaaagttggtggacctctctgaacttcatcttcctcatcagggaaatcatgagaaagatgtccatttgcaaagattgcttgagatcacgtttctaaagcatttatccaaatgcctcctgtagggtaaaggttcactgactggtgactgttgctgttgttcttatatttctggctttaggtagcatgtatcctctgaggagctttaagtcattttttctattacctttagtttggctaaataaataagttcttgtcacgtctttcaagttcaagagctattcctttgggttggttttgaattatgtttgtggtaaagagttactctggttattagaatctgtattacaggccagtgatagctggaattttagatgcttaagggaacacgtaagacagccatataatatatggctcccacatgtttatttttccagataagagaattttaaaaacaaacaagtctatcatctatcataaatagtacctcatgaaggacaggatatttggaacaataatctccaagaagtggcaattcctccctagaaaggtcacctttcatagacatatacacacgtgtgcatatgtgtgtgcacacaagcaaggctgcatgtttgcctggacatcctctttctctctgtctctctccatacgtagtgtgtgtgtgtgtgtgtgtgtgtgtgtgtgtgtgtgtgtatttttctctatgtggcaaaataaagagctggggctacatactgctgtctcacatattttttaaatatttgtatttttaaatacaggtgtatttttcttgctttgctgtcgatccgtgaacatgtcctcatgcatagacctctgccagctcccatttacaagccctgctctggacaaaggagatgtgatcaatgccacaggtgggggagaagagctccctgaggctcagcctagccttggggaagttgcgatctgccgagggcagtgaagctgtgggcacctgacctgctggcacgataactctgcgctcgttcgtggtcatgtttgggggtggcatgtgcttctcctccatgtagctgccgtagttcatcccaacggtgtctgggctgcccaccatcttcccgcctttggccacactgcattcatcaggagagttcctggaggagaagaaatattcttccattataacagcaatcaaagagcatgtctccatcgacttctcacaatacacagagagaaccaaagaagggcaaggcggaagagactgggggagaaaggacaagtgtgaaaagccaaatacaggcggggtgccgtggctcatgcctgtagtcccaacactttgggatgccgaggtgggcggatcatgaggtcaagagatccagaccatcctggccaacatggtgaaaccccgtctctactaaaaatacaaaaattagctgggcatgcctgtagtcccagctactcaggaggctgaggcaggaaaattgcttgaatccgggaggtggaggttgcagtgagctgagatcatgccactgcactccagactggcgacagagtaagattccatctcaaaacaaaaaagaaaagaaaagaaaagaaatgccgaaaacaggccttgccttctgtcctcccgaaatgcatattttgaagccctaactcccaatgtgatgatattaggagagagagcctttgggaggtaatttcagtttgatgaggtcatgagggtagagtcccacgatgggattagtgcccttattagaaaagaaagagaccagagctcgagctctctctctctctctctctctctctctctctctctctgccatgtaagggcagagcaagaaggtggccaggccatctgcaacccaaggacagagacctcaccagagactggccctgctggtgtctgattttagacttccaacctccagaagtatgcaagctcgagtcccattgtttcagccagccagtctgtggggctctgtgaaggcagcctgcacaggctaggacagtgcccatactggctagatgcacagaacacgcacaagggaggcggaactaccacctggcttctgtttcttaagcagctcctcctgaaactgtcatgtcaaaactccatctgtgacaactgattggggacacttgcagggaacagtgaactgctctttgttctcgcggtgtgacagcaaacaggcagagtagacagatgctgtggggcggcaccagggacactcgctgctcagtgaggtttatcctggaacgacgttccttctcaaaacctcagaatgaaatcctcctgctcaatttcaaatccctgcagccaatctttacatatggagctttgaagactcacagtgttccaggcttaggtgtagacaggaagggcagggaagggtgaggactgacgctaggggaggcctcatggggagtggactccagcagtcctagaggacccttgggaaagggatagggaaggaactgtgtggatgcagagaggggtcagctactgactactgaccgtgggcaacaggtcacagggctgctgttagtaaggcagtcactgtcatttggataaagtcaaacctacctttctggaaaaagaaaaggaaaacattttaaacagtgagttgtgaaagctacaggacattggtgaaatcgcatctgatagggaaatgctaaaaagaaaatccagcttagggccaggagtggtggctcacacctgtaatcccagcattttgggaggccgaggtgggcagatcacctgaggtcaggagttcaagaccagcctgatcaacatggagaaacccagtctttactaaaaatacaaaattagctgggcaagtggtggtgcatgcctttaatctcagctactcgggaggctgaggcaggagaatcccttgaacctgggaggttgaggtcgtggtgagctgagatggcgccattgcactccagcctgggcaacatgagtgaaactccatcaaaaaaagaagaaaggaaagaaagaaagaaagagagagagaaagagagagaaagaaaagagagagaaaatccagcttaagcagaaaacagaaaatacatgtcagtgccttcttagatggttaacacgtagatggtaaacccagggtcactgtagctgagaagtattaatatttagggtctgttgtctaaggcggatttccagaaatgcctctcaggctctatccaatgcatacatttttttcatattccttggaatctgggaaccttcgctttctctagattttagatttctatcccagtgtttctggttgtgggatccacgccaatgaagcctcatttatctcctccacttcttgttagttggagttctgcagagaacttggacaatcaaaaaactatgggcttggcatggatgtgaacttcaagtctaaggaggtcaaaaccatctgaggcaggagcgcactttctgagtggggtgagatggagaaggtcattccacacctgaaagccatagctgggatgtggacaggaagggaaagtgtttgttcagcatgtgggaacttgaaaatataggtttgttctcagcatcacttacaaatgtgtctgaagcctatggagggatcttaggtgttggcagtgaagagggtacactgccatctgcggatggaggttacagtcagggtcacgcaggactcaggccctaacatgggcctggaatgcacagccctgcctgatggcatcctcacagctgtgctaacatgaaggaaattttaaaataataatggtctgagttcccatgaagtagatcctgaatatttccaccgctgcctacacatgcattatttcctcttgatgctatttttcctggcttcacacatttatctctaaaagacccatcctaatatgaaaacacagagtgtcttcacttagactgagtttcctattcctctggaaaattccatcagttgagtagagtgtatatgttttggtatatttgtctcaaggagagaagttaccagggaagagaagttagagggattaggttctttaggaaaaagactttgcccagatgatgtgagtaactcaagtaacaactataaaatctagacaacctttgttcagattcaatcattcactcatccatttagacagctgttatcaagtgccggccgtataccaggtcccatcaattctttcttctccaacaacgcagttaacaatttgaaaagtaaaagatcaaagagatgtataaaattatagaaacaggccaggtgtggtgactcacgcctgtaatcccagcactttgggaggccgagctgggcggatcacctgaggtcgggagtttgagaccagcctgaccaacatggaaaaaccctgtctctacttaaaaaaaaaaattagccgggcgtggtggtgcatgcccgtaatcccagctactcgggaggctgaggcaggagaatcgcttgaaccagggaggcggaggttgcggtgagccaagaccacgccattgcaccccagcctgggcaacaagagcaagactccatgtcaaaaaaaaaaagaattatagaaacaggggacattgaggattttgaacccttcagaccaacccctttttcattttcttttagttctttctagtttaattttcatatccgaggacaagaactctaggcatagatcacaagagtttctctgtgacattaaagtagatccttcaggctggttgcggcagctcatgcctgtaatctcagcactttgggaggctgaggcaggcagatcacttgaggctaagtgttcgagaccagcctggcctcccaagtagctggcattacaggcgcctgccaccacgcctggctgatttttgtatttttagtagagacggggtttcaccatgttggccaggctggtctcgaactcctgacctaaggtgatccttctgccttggcttcccaaggtgctgggattacaggcgtgagccacttcacccaggtttctcttgcaaattttaacagcaaaagagtagccttaacatgtttgggatctgttttgggagcttaatagttatcagtcttcaccacagcgaactgtgttgctggcattgtctccactttccagaggtgtgaactgagtactcaaaacacaaggggctggctccaggactcacagccaggaggaggtagaatgagacttcagtgcgggtggcccgaactctccatccctgcttcttaaccctgaacagaatgactccacaaagtaaaggcaagacaatgtcttttcaaaggtaactagatcttcatttcaggaaggcatcagggactccctgacccatacactactctggtttaaggtgtacactaaagcactcatcctgacatactctcctaccctgggactgttcattccctgaaaagcatgtgcatgacacaaacagggcacatatacaagatgcaaataagaaagaggagtgattcctggagaagaaaagaattttcagagatatctgctttacttaagaaaaggacgccaggcacagtggctcacgcatataatcccagcattttgggaggccaagataggtgaattgttttagctcaggagttcaagaccagcctggacaacatgaaaaatgtgtttacaaaaaatacaaaaattagtcgggcatggtgtgcacctgtagtcccagctactcaggaggctcaggtgggaggatcacctgagcctggggaggttgagactgcagtgagctgagatcatgctactgcactgcagcctggacaacagagcaaaaccgtgtctcaaaaaaaaaacaaaagagagaaaaaaagaaaaggaaattttatcacaattcagagaactgaaaagtgttcatttgaaagtctcactataaatacatttctagctctgtgcccaagaaaagatccacactgcacaaatgtgtgtcttgattactccactgcaaccccaccttcaccaggcattccgaggctcacacatcgccgggaaaaagttcccgcaaacagcttggtatgtcacctgcaccaagcgctgcccagcatagaggaccacgtgttctccattctcacatgataaggatttggacgttcaatgcattgttttattgtgcacatgacaaagagtatgctgtgcagggaatgaacagtcctgaagtaggacagtgtgtcaggatgagtgctgcaatgtacactttaaaccagagtagtgtatgggtcagggagtccctgatgccttcctgaaatgaagactagttaccttttaaacatacacatacttttaaacatacacatacttgcatatgtgtgttgcagcagttcctgagaatattctcaggctattcagcaggtgcctgtcaaacagataatcatttagtaaatattaaatgtatctgtctttttgtttggggtggaaatttctttattgcaaataagcgtggttcaagatattgctctcacagactcctttgaggacaaacaaaaatcattttgtctttttatttaatttaaatagttttgggggaacaggtggtgtctggttacacgaataagttctttagtggtgatttctgagattttgttgcacccatcacccaagcagtaaacactgtacccagtgtgcaatcttttctccctcacccactcccatgcttcccccagagtccccaaagtccactgtatcattcttatgcttttgtgtcctcatagcttagcttctagttataagtgagaacacacaatatttggttttccattcctgagttacttcggttagaataatggtctccaactccatccaagttgctgcaaatgccattttcttccttttcatgggtgcatagtattccatggtgtgtgtgtgtatatacacacacgcatatatacacatatacccacacatatacatatgtatatatgtacatatacacatatatgtatatctacatatgcacacatatacatatataatatgtacacatatacatatatatgtacacatatacacatgtacatacgcacatataaacatgtgtgtatacatgtatacacgtgtacacatgtacatatacacatatgtgtatatacatgtatgcacatgtacatatatacatatgtgtatatacatgtatgcacatgtacatatatacatatgtgtatatgtacatgtatacacatgtacatatatacatatgtgtatatgtacatgtatacacatgtacatatatacatatgtgtatatatacatgtatacacatgtacatatatacatatatgtgtatatatgtatatatgtgtgtatacatgtatatgtgtgtgcatatatgtctatatatatgtgtgtatatatatatacacacacacacacacaccacattttctttatccactcattggttgatgggcatttaggctggttccacatttttgcaattgcgaattgtgctgctataaacatgcatgcgcaagtgtctttttcatttcctctgggtagataaccagtggtgggattgctggatcaaatggtagttttacttctaattttccatactgttttccacagtggttgtactagttccatagtggttgtactagtttccatgctgttttccatagtggttgtactagtttacattcccattggcagtgtaaaagtgttcccttttcaccatatccatgccaacatctattttttttttatttttaatgatggccattcttgcaggagtaaaatggtatcaccctgtggtcttgatttgcatttccctgataacaagtgatgttgagtgttttttcatgtttgttggccatttgtatttcttcttttgagaattgtctattcatgtccttaacccattttttgatgaaattatttatttttttcttgctgatttgtttgagttgtcgattctggatattagtcctttgtcaaatgcatagtttgcaaatattttcttccactctgtgggttgtctgtttgctgattatttcttttgctgtgaagaaagtttttggtttaactaagtcccatctatttatctttgtttttgttgcatttgcttttggattcttggtcatgaactgttattctcaaatttacattttcagttccaggttctatttgtcacccacagacattagtcttgacagtcctatgcaatatgtggcatcaacaagagtaaacaggagctgggaagacagatacttccctctgctcacagcagcagaaattccacattagccagggggccccaagaggtggggggctggttcagaattctgagaaagaactgaacaatagcccaatggctgggatattaaaaagccagccataacacctcacaactccctagcaacacccttggggccacacagcctcaaactcctgagctcaagcaatcctccttggttcagcctccctatgaatagctgggactacaggccacactccttgaggagtgtaacctctgcagcaatctcacacttttccatggcatttggtcataactgtggtcactcacaggaacacagaaatagtgtaggaagacaaccaaacattcatgatggaaataaaaaaaaccagaatgctggtgtccttcttctagtaactggagacgtgcccaatgaaactggcttgttgagcttcaaacaataatctcccttaaacagcagttggagaattaagttctaatcatttaaaatcatgagcactgacttcttaaaacatactagtattctgaattaatgagaaaaggacacggcaaagaatatcaaatacattggaaattttgttaaatttgagttaaggagagaaggcagacacgttgctaagcccagttgggttctcatagggttactgaatcagagggctggaagaagccccattttcaagcccccagacatgactgtctggaaaccacttggatgaacaagagtttagcttcgttaacagttttttagggaggggcttcgtaattttcctctgcaactccagagttctatttataaatatgtatagtggttttaaatagccattattcccctacctgtgtgcaagctatgtgaagtttggggtggcttataaaaatacatataagacaaaatgataacataaataattaacagaataaaaatgaggaaacaagggccaaaaaggaattaagagatgaaagcagcccactgagtaagcttactatttatcctgctgaggtaggataccaattcaactctgagctttctactagccaaagcaaagacacaagtgcatctgatgacaaggtttgaggtattaataagctacatacaaaccagttattcagcagaaataaagctctccctgggttaagctttgagagtttttctcggggcttctcatgaagaaaactggattatgcagtaaacaatatcgttcccaacatctcataatacatctaagaccatcccgcaccgtgccaggcgtagctggtggcagagcaggacgctccctgcacacagtgctcacatgctgcagccacagaggatgagagacggcatgtccccagcctctcctccttactggctgccattggaaagatcagacctgtcagagaagtcaatgcaaaaacatgaaaaaaacgtgtaattaaaaaaggagaaaaccttgagagatgcagtgttatacatgcctctagtttcataactcccaaatttctagatttgatttgattttattgttttttaagagacagggtcttgctctgtcacccaggctggagtacagaggtatgattatagctcactgcagtctcaaactcctgggctcaagcgatcctcttgcctcagcctcccaagtagttgggactacaggcacgtgccaccacacccagctgttttttaattatttgtatagatggggtctcactatgttgcccaggctggcctctaactcctgtcctcaagcaatcctcccacctcagcctccccaagaactgggattgcaggcatgagctgctgcactgaaacccctaatttctagattttaaattcaaatttaccaacactaaatagggtcatgtttatgtctcccaagagcaccaaatgcactgtgggtaaacaactctttccaggcctcagttggttaatcttccaaccagtatttcactgttgactaatgatgagcatggctccagactctttccacgtgtttatgttataataaacatatggataaagcatttaacatggtgcctggcacatgaccacgccaggtgtcagctattgctgttagttcatttcatctgcacatctccatgacagaaatactcgaaagcaggagccttgttacagatgaagcacagagaggttggataacttgcccaagatcacacagccagtagtggaagaattgggatttgaacctagatagtcatggtctcgactccaagtacttcaccgccccactctatgcccttgcttggtaaatccgtgtgaggagtctttcatagacctaaagcaccattgaatggatcctcagaaaacttaatttcatcactattaagtattctaaaagaacatcttcagagtggccctgaagacagtcatggatgagggttacagacgtgagctgagcagggcagccacgaaggagcaaggcagggccccgtgggagacttggaaggtggcaatgtttatgtagagatataaataggttttgataagtttggtctaaaagaaatagtcatctcaatttgcagttaagcgttctatgcttctccccaaaacttcattgctgtgcccagcagggtgcatgttttacacagatgatgggcaaacattcttaagtgcaaaaggaaaccagacaaaaagtccccatgacgagacagccgagtgggagtgcatctgactctgactgcaggcccaaaaagatggaggtgaggaccaggacaggagctggaccactggggaagcagtcaatctaattttttaagattaaataaaataagtccaagatgaaagcctccttgagctgtcgtccatacataataccccttaaacaaaaaaaaagcggggttggtggtggggactaatattactgaaaaaacatactgagaaatgtaaaatttggtctttagtctttgaaaaacaaaataaacttggcatctgactttggttttctcacatcagagtctacttacagcgaggcaatttccgtcatggaaagaacccgcaatgaaatggcacagccgtggccattagcttgacaagcatggagcctcagcccttgtgagtgtgaatgggcctcatttatccaagaacggcactgaatacatcccagaggggcagccccaagctcgctggccacattaaatctgattcaccctcacttcagaacacttagcaggggcccactccttggagaaagtccaaggcaagtcagaatgtaattgcggaaatcaatatgtcttcttctttgagtcagtggaggcaaacccgctaatcctgtcgaaaatctacctattcttctagagccatcctccttcctaatcctctgaattcctcttgcacctggacacgactttccaaccccttgttctccatcacatgctggtgaaatgtccccgaactcttccaaagctttctccctcctgctaccagagtgctctcccccaaacagaaatgcaagctgcccatgtccaacctaacccccatcatggcccagagcccctccctagattctcctcagtgatctggctctggagcccctcaattcactcatttgtttagcaaatatctgtggagcatctttctaggccaagcactgccccaggtactggagttatatcagtgtctctattaacatggggctggcatttgagtagccaaagcccctctccccaactccatgtgctctgtgctcaaagaccacattccacatcaccccctagtctcttcccttcaggccttcacttttgctactccctctgccttcaaggcctatgaccacctgatacctgccctattcacctgttcaccacctggtacctgctctattcacctgtccatgctcacctctaggttctctacaagcctttcctgggccgccagagaggaatgtctcccttccaattgcaccattctctgtattttctcagtaagtgtctgcaggatgagtgagtacatttatgaatgaatcttccatttaaatattgagttccttatctcatacctgcagtgcaagagaaagcccctcgtgttgcagtcagaaaaccattgctgaccttggttgaccttagatgggtcacctaacctttcgaggctcaactccttcattcataaaaatgaatggatgctttcttgaggttgctgtgaggacatccctgagatgatgcctgtgaagaaagtctgcaaactgtgaagcactatacagattaacacagcaacatactgcatgtgcatggctgtgcatgcgtgtatgtgggtgtaaatgtgaggctttttgttcttggcaactgttcataactgtacctcggtgaactcttaggtaggtcaggaagctaaggtttactattgtgcagtgttcagcatgcaactgctttttggaatgtcactgtctttctgaatgttccttttggtttattaggttagttcacattaagaagaacttggtgaggaagccacatggaagaaatggaaaggctttctttggcagctctaccctaagagggcaaaggggtcagttctgcgagagaacccccacaaggaggctggcccgggacaagcattccaggcctgtctcaagtctgaatacaaataaatcccttctcaggtggttttcttcataaggatcctaaaagcatatacttagtcctaatcgactgagcaagctcctaatcaagtttcatagtgtgaatcggaggtcagtcaccacaaaaggtatttttaggaccccagacaaggaggggattgtctggagcgctgcagggtaatttgtgggtctgttttatttctgaatcagaggcagtggaaaagctgtttcagaccccatggctggagcagcgggtggagctcagcagtgattcatgtagaactccgggctcaaactgaaaccgtagatgtttgtcttcacagctgtgtgttatttttacccttactaaatattctctcttacacctggaatttcagcctcttcccaacagtcctgttccctcccccttccctgaagcagttgaagacaaaattaattaaaaagtcaccaccagctcaccaacagttagttctttgtccccttaaaggggctcgatgtttccctgagaaagtttcattatttaagtttatatttctctttacagccaaaaacgaatgccagcaagaccgtgttgcttttagatcttgaaaactggagggaaatgcaccattttgggattcatcatttgaaaacaaaatgttctgtagcataagatctctacaagcagttacatgacaaagatcagatgtgacatcttttctatcttgtgcacgtcttttaatttgtctgaaagactcctttttcagagaagaaaggattgagcccaatagccagtatggtgcttcatgtttttataacaggccaggtgaatcctggtaaccaaaacaattttactttctttttttcttttttttttttttttgagacggagttttgctcttgttgcctaggctggagtgcaatggcgcgatctcagctcactgcaacctccgcccccactgggttcaagcgattctcccgcctcagcctccgggattataggcacctggctaattttttttttaatatatatttttagtagagatggggtttcaccatgttggccaggctggtctcgaactcctgacccacctattatttttaaaatgtgattgttttggaaacacctggtgaggttaatgtaaaggtgagtgcaggtgaactgacctgatgtgataaagtaagatagtaataaatgtttctaaaatgtgtaacatatacaaaaaatcaaaatgcagttggcacttggatttggtgcatcttgtcactgcttgtctgacacgtggagagaaccttgctatccctctcaatgcaggaaagacgttcagcttcttctaagaagccctgagggagtgaagaagagtccaggcctgtggtcaaatggccaactttcactttcactaactttcacttgagcaagtgacgaaaacttttggaaactcagtggtcatccgtaaatgtgaataatcataataatgtcatctcatagatgtttgagaaaactggacaatatgttgtataccaaaatctattaataaatcatgtgggttttagaaatatgggttaatattatccctttcagggtctttttctcctgcccaggtagagttgatggtaccctcatatctgttattgctgggccctgaacatcgctctgtactgaatgtgtcttatgatctcacagaatctttttcacctttggtagaccatgagctcctcttagttccttttttttttctttctctcttttttttttttgagacagagtcttgctctgtcactggagtgcagtgccgtgatctcagctcattgcaacctctgcctcccaggttcaagtgattctcctgtctcagcctcctgagtagctgggactacaggcacctgccaccatgcccagctaacttctgtattttttgtagagatgggggtttcaccatgttggccaggctggtcttgaactcctgacctcaagtgatctgcccacctcagcctcccaaagtgctgggattacaagtgtgagccacctgcacccggccagcttcacttaattcttaatccatctccatcgaagctaacacagtccatgatgcagattaaacactaaatacacgttggtttcctgcagcatttgtcaacttcgacactagtgccactcggagccaggtcactctttggacaggtgggggtgggggctgcaggggcgctgccctgtgtactgcaggatgtccccggcctctacccaccagacaccagtaacacctcccagctgtgaccagcagaaacacgagcattggcaaatgcctctgggggccacatcacgatggttgagaaccactgggctaatgaattaagatccactgagctcaggcaaggaggcaagagcctcttgttttacctggtgtttattagagagaagttcctgtccccagtgtctggggtgatgcttaaaaggggcccttaaaggggcctctatgctcatgaggattcctagttatggtttgtccgtaccttgtttggggtacattccccaagccttggcccatcctcgcttcctcttttcctcatgccatatgtccaacccatcagcaaagcacgttaattccaccttccaactatacccaggatgcgactgcctctcccaccctcccttgctaccactctcacccactctcacgcagatgtctcccatcctacacccacattttctcaggaagacttcaacacaggagccagagaggccctgcaaaatctaagtaacactatatccctcctttgcctcaagtcccctaatgatttctgaactcaccagaaagtgaaagtcaaagtccggcaatggccccacgggctctccaaactcatcatctattactcttcttcttggacactaaacagcagccacgatggcctgcttgttgtcctcgaacacctcaagctgacctcagggcctttgcatttagcattccctcctcttggaatattttctgctgtttaatcacgggcattctccctcaactgcctttgcagctttactcaaacatcacttttttgtgatcttctccagccaccttctttagagctgccatccgcttcacgtctttatttttctccttagcatttaccatgatctaacctgctgtgttttcataagtggtctgatgtcatgaccatcttcactgctagaaagtgaacttagtgaggcaaaacttttttgtatattttatcactctatcccaagagactaggaaagtaggtgctcaataaatattcattgaatgaatgaatgactccacgcataaacagtatgtctaaggccctgatggacccagcagatactccctactttttctcatctccatcacatgacaaatggcatgttttttaaataacatctataaaacatcctgctatctgacccgaggctggagttattcatggcatgcaatgaatctatcccagagagaggcaaggcccagatagcattgtctctcgctgcacaggcccagctgggcaaagcgccaatgtggcgggagggaaggaggtatttctcaactcaggcaaggacttctggggaacaaccccacctccgcgtagatcctcccagatcattcgctgggtgggtcacctttacccagctgctgggctttctcatttttcatctccttggatcgtgcaacagagcagtggttctcagactaccaggcatcggaatcccgcagagggctccttcaaacacagcgtgctgggctgccacccaggtctcttccgattctagggcagggcctaagaagccgcatctcaaacaagctcccaggtggaggtgatgctgctggtcccggagcccacgctgagaatcaccacaccgggggaaccctcactcaacagaatcaaacatggcaatggctccaggtggcctgcagactgggctgaggggggactcacagcatggcacataaattgactgagttccacctgcagtgagcctccaggtgggcttcacgaaatcgccatcgcctgtggaaaggggaaggtgccacttagtgtaagctgcctgtgatctggctggcctgagctggggatgctcagatggaggaaaagcagcctgctctgcacagacctgccagcctgctcacgagaagacagtttgcttgtggaccatgagtgagcaggtgttacctcttggcttatcctgctagtctatcatgacttgagctttggggacctcacagcaaattcagggcattggtagggagctcacgagaggctgagcaggcgctgaaactcccagccaggcccttggtgtggatggcacaggaaaacagctggttttagtttggccacacactgacagttctccattgtgtgaacacttggggctttctggtgcgtgaggctagagtgaagaaagggagagggtggctgtggaccaccgaagctgaaaaatgatgtcctgtgtctacacaacgtgcaattagattactgtctgcaagaatgctgctgtttgatctggcagtggccaagccaaacccacaaggacatcccagttggctcgcaaagcagtggttcctttctctcctgtttttcttttattatgctttacagaaactctattataatggcaacagatctcgtttcaccacttgtatttcatttcaggagcttgtaagcacgttaggactgaggttttgtagaattccactattcggttgggaactaagtccttcctttctctcaaagcacatggcctttttctccgtgggtactggatggatagggatggacagagggcactattcccaagctgggtattctaggcagaaggaggtgggccatgttctggaaagacctaagctgcagagagtgcacttctcccgtggaggtgtctgcaagatagtcaggggccacaaaggtaacagcccacaagttctagccaaagagtaatatttgacttacgtaacttccccttggacttgacttcaagtggcatgtgcactacaggaaagcccattatgcataagctaagaggagggacaattagaagaagctattgggccaggggccaggagatgggctaactccctggcacagctggcctggggcttccgagtctggaaggatgcaggtgcaggtagtggagcgttgaggagctgcactcctggcggggctcctccagaggcaggcagccacacactgctctgcagcatctcatctgtgagcccctccgtggcagaatctgcgtctccgtgaaccctgcctctgccctggcccctcgagctgggctgacacagcccggtgctggttcacggtgtccaaaataaagcagagtgaatcacgcccatgttcccttttatggagctgcacctgacattcgtaaagagcccatagtgaggccgggcatggtggctcacgcttgtaatcccagcactttgggaggctgaggcgggtggatcacctgaggtaaggagttcgagaccagcctggacaacatggtgaagccccatctccgctaaaaatatgaaaactagccactcgggaggctgaggcaggagaatcgcttgaactcgggaggcagaggttgcagtgagccgagattgtgccattgcattccagcctgggtgacaagagcaaaactgtctcaaaaaaaaaaaaaaaaaaaaaaaaaagcccacagtgagtcagcaaagcctgcggatgggatcccaggcagtcctttgtctgccccaaggctgcctccaacctctggctgagatgagtcttagctccactgataactgttcagctttcttttcccccattccccttcaggaagcccgttggattgttaatagcagaacactgactcaccacttatgtttcaattctttcagatcactgagcttgagcagccccctagtgaacctctgacctgacacgccaccccctttaccacccgctgtccagtcaggctgagctccagcagcagcggtgaactggccccccagagcacactggtttggagatctaaaaagtacaatgggtcaccagtcactgatgagtgcagcatccctggaagtcaggtgtgggggtcagtttcctgtgtcaacttggccaggccgtagcacccagtgacttaatcaaatgctaactgaggttgtactgggaaggcatttgcacaggtagctagtcagttgaacttgactaaaggagatgatgtcagataatgtgagtgggccttgtctaatcagttgaaggccttaagaacaaagcctgcggtttccagagcagaagaaattctgcctactttccagcctgccagcctcccctgcagatctcagacctgcccactcccacaactgcattagccaattccttcaaataaatatcttaaaatgtaaaaatatcctataagttctatttctctagagaatcccaactgatacaccaggccagcacccagacacaatgccaggagacacactgagctctgggggagacgggcatgagctctgtatctttctcttctacaaaggggattagtgtcagccactcctctccctccccctggaacatccttgtgggtaggggacgatgacacttggtgactggttgacatctgtacattgctagatgcctcaaagcggaggcagcctctgcagccagtgttcctcccctgcctattacaacccagctgcccttttcctcaaaggaggcacgtaggcctggattgaaggcagatgaggtccaccttgttcccttcatgaacagcacctgccaaaccgacatcaccgaacccaccggaggacccggaggatgaagaggatgacatgatggtcttcactcggtatccacccaccaaaacacatcaccgatgctttaggagctggaacagcattgaaagtttatgacggcagcaatctgggcaatgttagaattctatgagccctgagagaggaactcttaaagttcccattgtttccttgaaagaaaatgtcaaggccgggcgcggtggctaacacctgtaatcccagcaatctgagaggccaagatgggtggattgagttcgagaccagcctggccaacatggtgaaaccccatctctactaaaaatacaaaatttagccaggcatggtggcggatgcctgtaatcccagctactcaggaggctgaggcaggggagtcgcttgaaccccggggggtggaggttgcagtaagctgagatcgtgccacttccctgcagcctgggtaaaaaagagcaaaactccatctaaaagaaaaataaaaaagaaagaaaatgtccagttcccctgaaaaagatgtttcccggaaagagaccctcagcgcagcaccagcctttcacttgcctgacagaaaaaccacccaagagctttccccagtctgctgcgctgagggccctggggcggaactgccctggtgtctttcttatggactgaagctcctggtgtctttctttcttatagactgtagccccttgcctggggctcagggttaccccaaactcccaacctgtacccctggggtcacaacacaggctggaaaagcttccccatgcctggccaggagggagaggagacatcagctaccaaggggcatcacaggctcacactaaggaaaacagtgtttgcacttctcccacaaacagaatgcttatttttttattttttatttttatttttttgagatggagtttctctctgtcgcccaggctggagtgcagtggcgcgatctcggctcactgcaagctccgcctcccgggttcatgccattctcctgcctcagcctcccgagtagctgggactacaggtgcccaccaccacgcccggctaattttttgtatttttagtagagacagggtttcaccatgttagccaggatggtctcgatctcttgacctcgtgatccacccgccttggcctcccagagtgctgggattacaggcgtgagccactgcgcccggccagaatgcttattttattttaaattcgggagtaacacagtgagaacaatagaaactttcatttctggagcactgttctcgcctcctcactcagtctcccttcggaggcttgctgaatccagactggccccaggccagactctcaaacaagggccaggacatggctcactctgcctgttgtccatcggaaatcatctcagtgcccttttgtctgagatgtttccttcctctctccccaccttccaacatccccctcctccctgcaggtgaattgctcataggtagaaattagcctctgcagaagaaaagctttagaaatgtgtcccggtcttagtgtctccgccgtgatcacgctggcatatatgggatcatatgaccccacccaaaacagaattcattcagtgtttccaggctgtgttccaccaactgatctactgcataaacactgctgcattctttagaacatgattaccctgcattcttctgtgtttcagaaatatatatagttaatgatcaacagaaacattgtatcaaatgcataggatttatgggtaaaaaatatttacatgtaatcattaatttcccacaactttggtgtcctggacccatcattgcattttctatccaggtccttctgtaactccaggaatgaatctcttgatgagattcaaaaatatttacatgtaatcattaatttcccacaactttggtgtcctggacccatcattgcattttctacccaggtccttctgtaactccaggaatgaatctcctgatgagattcaagatgggcctgcctcgagttccacttaaaggaccagtgcggtggcaatatgtagcatcagagccagtgcactttcaagaagcagatgcacagacgcaaactgacttctcagagtggaggagtgttctggcatctcccatctccccatctggcacgtccagccttgccgttgacattccctctaggacactgtgacttggcaccttcattaacaccacactaggaattgacgcaaccgtttccagacttataaactatgacacttataataaacctttttagcgttaaaacatatatgtaacaaaaaggccccattacagcttcaacagagtggaaaatgctcagggtgtggagtcaaacactcctggtttaaatccaaactctgattccatttaagtggtgatttggggtcagactggaaatgcctgatcacaggtttcttcatccatcaaatggggtcaagtatacttcatgaggggctgctcggaggactgaggggctactggatataaaagggctttgtacacagtaaagtttccgaaaatgtgagctgttcttatgacctgatggtagattatgcaacatttcgaagaaataatctgttctttatcctaagatttgatattctttttcctgaatatatatggggtattagatcataattgaaattaattttacttttcaaaactacacagaattcaacactttttgagggccagggacagttctgcatttggtaatacattttacgtgacagttgtatgttcatgacaaactcagggaagctaataattatgggagacactggagagggctttatgtgtaagctaagaggaggaaaaaaaaaaaaaacaaacagcaggcattaagagaagaggaccgcagagatcagagggtggggtgagggtggagggcagacaatggagatccactagcaaattcaagtggcttggacatacgccgcactgcctggccactagctgacactctccctttgtgaaaacataagacggcattattttccaggcaatcaaacctcagatgaattctgccatatgtgggcaaggctcccctcccacagagccctcgtgcctgggaaatagaattgaacacatcttcaaagagagttcttggtaaatatactactaattttacaaactccatcctctacacaaaccactggagaacacattttcccagcgctgtccaacgtcaccgttcaatggcctttctttctttctttcttcttctttttttttttttttttttgttagccagagtcttgctctgtcgcccaggctggagtgcagtggcatgatcccggctcactgcaacctctgcctcctggattcaagtgattctcctgcctcaggctcccgagtagctgggattacaggcacagtggccttgctttctaagtcaatctttagagaagcatgactgacttccactttgcctttgcaaaggataggaaaatgggaggtcagggagagaaaggggcggaagtctccttaccttgagccattcacctggctagggttacattccattttgatggtgaccctggctgggggttgagacagccaatcctgctgagggacgcgtgggctcatcttggaagtctgtccatagtcgctggaggaggacgcggtcatctctgtcttagccaggtgtggcgttccgtaggcacactcaaacaacgactggtcctcactcacaactgataaggcttcctgaatgcccaaagaaacacataattcaagacactccaacagacagtcatgtttcaaaaagttgttgatttcagagtcctttctaactgggaccacattttagatcgtttttatggtctccatttctacctttcagaagaaaaaagtagcttgtttttctttcctcgggacagtaagagttagaaatgccagcctagaaaaacttttatgcaggtctcgaagcatcccaggcttgactgtggcagggcagcagaatatccactttaatctcaacttaaggaagttgaatttcaaaggtcttagaagacatccaattgcatgtgtcactatttgacaaatgcaatctataattcaagcagacagggtacagagcggtcatgaggattaaaaaaaagaaatctgaaggccaacacctaagcatctggcaaaattgccacattcctggggattttgcggaagagggacttagaggaagacagagggatcaatggagcaccaaagggcaaccaaccaaagatacaaacgtttccactctaagttattagccgaagtacagtttcaagtggtgcttccatgatggtgagcatctggatgataaatgaaccaaaaaaaaaaaaaaaaaaaaaaaaaaagctgtgaagtatccagatgcttccaaacagcaggatgtttaaaatatctggatcactgacaagctcttttttccccttactttcaattaatatcttcgctcttttgcatgatttggtgagaagaaatagcaatttgtcattgttggatcaatcatttttcgtggttttaagtcaaacaagtggttagccaatggctatgtttatattctacagccaatgagcaacggcaagtttgggaaatttcaacgacttaaatgatggcttgtgctgcaatgacacagagctgttgtgatacaatccaattttggttcttataacagacaaaaagaattccacatgaatgctcatttttatattagtcctttggcatcctcagtattgacatcaactagtgagaagcaaaggctagttgggccacacatttttatttaaaaaaaaagaaaaagaaaagaactttggaggcagagcaggggaggcaggggagtgtgggctgcgcagacccttccagtccaaacttgtcatctccaaatgagaaatctgagacccagaaaggtctagagctaatcttgaatgagctggccatgatcaaccaggggattagtgatgggaatgacttgtgtattaccatctgccttctccttgcccccacagccctatgatgccctttgtgacatttttttcctttgggacatgtgtttaaattagcaccctcttccccttctctgagatgacctttacataaataagggtgcttcccatcagtaatcacaccctagaagcagcccttctgagatggagagcttcctctccacccagaaggatcagaatttttaggaaacaatcacccccaactccacatctactctgtcgctcgatcctccacctgtcccaggaccaagttttttccttagcttcccaagtgcacaaacttctttgccagacacacggcactgagaatcagcaaggaggaagaatcaaaacaaactcaaacctctgtctctcaaagtggtggtcaggtgtctgtgctaaagcaaaagcccccatcctggactccataagtatctgtagaattacagccctgtgacaccctgggaaagactaagcctgctgtccaaacagtaatgcaaaatgtaccaaagagtcaggtaggccagacagagaaccagaatcaggcacaagggaaaaaagtcatcttgaatagacagcaaaatcaaactcatcaacaaccaaaaatgatacgaggcagtgacacagaagttgacagtacagaaacggcatcctagatgttagggaacctgaaattcatggctttctcttccagtcacaattgagtggccaaaacaaggaatctaaacacatagatgtgggtttcaaagtaaaatcagcaccatagacttagtcatgctaattaagacaaaaattagaccttattaaaaaatttttgcaaaacagatactcccttcccatggtggcactggctagtgtgttttacaggctcagaacaggaaacagagctgatggctgctgcctctctccttcctgggcctgagactcgaccaaggctcgcaggggaataacacactatgtaatgttagctttggctcacccatgatgagaaacatgaacaaatgtgtgatttatatcagaaattggcgaaaacaggttatatatataagaaacaggctaaatttaaaattacaaactaaaaaggaaatggctgcaacaataacaaacaagcaataactttaaagtattagtatttctccaagataaagtaagcttacttctgcaaacaaagccaatagccacaaaaatgtagtgtaagtttgaataataaaaaaaagaccaaaatattagaactaaaatgaagcttaagtgtgtgtttgtaggggaaggaatccattctcacatctggcaaagcattatttcagcacatggttttctaaagaaagaaatcaaagttaattgagatcgatttaggaaggaaaaaaccctcagaaatgctagagatgggggaggcatgcctcctttttttgcatcttaaaattcttctcacagctaatattgcacaaaaatgaggaagggaatataattcagaatattgaaagcaacccctcagttgcttttgttcattagaagggaaaaattctgaaaataaggaagcttcaggataaacacttcaaaagaggtgaaatacagtccacattttgaaaagacagagcaacccaaactatgccccaaagactttgttgattgtcactcaacaaaggctgctgaacacctaggatgaagtacagctcaggaaaaggaaacaaatgaataaagaaaatctctctcacatacacattttgggagtaagaagaagctgaggggttttcacagacccattcccacaacagcggtcactaaagttaagtgctgctcttcagaagcaaaccaaggcacagccctgccacatctttgtcctcccacttgacttggctgttggcaggtttcatcatcccttcggttaaagcttgaatggacacacgctgctgcatagggccctccctgcctggcagccctgtgacttcaaaggggagagaggatctagcccagtaggattaaaaccagaaaaagagtgctgaacacaggctgctaatcaggaccacatgagttctttaactccagctctgggagagacttcctggccttgactgacatgtctctccttccctgcagcctggctcctcctctttataactagcagatctcacctacctacttacctgcctgcctacctgccggccaaggtaggcagctgccttagttagcatgtatagattgttattgcagaaactctggccagccacaaggcttgggatctgcttcagtggctttataacagagaatattttaaacgtcaaaatctggcagatatgtggcataatcatttcatatgcctgcttctatgttactataaaaagacctgaactttagattggtgtttgccaatgtgtggggtgtttttttctgtagctccaggaaagttgggatattcccatcaggcaaatggcaggctaccaagctcatttttaaataacttacgagaaacacataattctaagcaaattacccccaaacaaaaggtactactgtgttagtactgtagtattgattatttcatttcaatacggaatataccaataacacatgaggaccattcctttggattttggtcatgggataacagttccagaaatgaagggaggtcccaccaggttatatttcatattataactctaaaatatgcatctattttcaagtaactagagtacaaaaaaggatccaaaatacattagaacactgaaaaagaaaactaacaaagttgaatgcatactgacattttcagcaaagtatttcaggaatcctgatgcctttctataacagatgaatactttgcaagatgcctatttctcaaccaaagtattagaaaataaaggcccaaaattgattctaatttgtgatccttatagctcataaaaatattacattgttaatacagagaatccatcatacttaacctcttttgaaaatttgggagtggtaaagtgttgaaactgagaaaatctttaagaatggtcaggtgaatttcacatctggagtaagcaaaggcatccatggtcctttcgtggttttcaaaaattaggaagatggccagaactaggcctctcgagaattggattatcaaacccaccttcaatgttttcaagtcttatatgctataattatttgataattatgaaaaacaaatggaacaactaagtggaacaagaattgtatgatcatgatcatgcttaaaaaaaaaaaaatcttggttcgggcatggtggctcacccctgtaatccaagcactttgagaggccaaggtgggtgggtcatgagttcaggagatcgagaccatacaaaaatccaaaaaaaaaacaaagaaaaaaaaatagccaggcgtgatggtgggcgcctgtagtcccagctactcaagagggtgaggcaggagaattgcttgaacccgggaagcggaggttgcagtgagccgggatcacgcgactgcactccagccgaggtgacagagtgagactccatctcaaaaaaataaaataaaataagaaataaaaaataaaaaaatcttaaagaagtccttgctgctatcacaacacagtgtggagatcattcacttaggaagccagcatcatcttcaatcaatagcctactttttctgtcagttttaatcccattacaatccaatacaaaacccttccttaaatttccctcacatataaccacgcagaatttggtacatcacttaactccctatattgccatcttttaaccactttcataaatagcttatccaccaaataaaccaggttaccttaagcactttcatgcaatatcctcttaaattctattttgttgattacaagatacaccacttgtcacattttatcagctctgaaatatgaaaatgaaaggcttatcctaggtatcaggcagcatttcttcttctctgatggcagataaaataatgggacattttatatccaatgacatcttacattttatgaaaaatgatcatttaatccttacaattgtcctataaggtcagctgtgattcttgcccacccatcagaaagtgcgattagagaagtaacatcaacagtgaggatgaggcagaaacagggtttgtgtctgtgaatggaatcattccccaaggctgtagactggccactacctggctgttactggaaggaagaagttggattaagaaaagtcacacggtggagtgttttggtgcctgctcttgccatgagagatggaatcacctagagagagacagagagagagaggctggtagagggaagagacagaagaaagatgaagggataagtgtccagaatccctggatctgggatggaataaaggatctggatggtaaacggagagtgctgggaaccagtaaggacttctctaggtataccatgctcttctatgagcctaggggatgtgtagcaatgggccctgcatacagttaatcatttcttttgcaatggcttaaatcaacaaccttgttcttttctttgattaatcagattattcagacacaaagacatggccaggtgttgggatgtgttcattgcaggtggatgcctgccttctcttaatgagtactatgcaggaaaactaggacaggtaggagtaccatttataaatatgctggagcctatgccactttgggcggcctttagtggatgtctgcagacctaaggatattggaaatctatctattaggctgtcgcaggctctattgtttatagtttctcttcaaggcagcacatatgcagtagatgcttctaaaaggtctagtatctaattgtatttggaggaggaaaaaacaacacaaacaaaatagacaatgcacttagagaaagctctgctctcccaccataagcctgacaaagatactccagtccttcaggagtttttattctaaatgtgtgcacttttgcaattctgatgccaccagtatctcattaaacaagaatcttcatctgaccagtgtgtcttttatttacaacacacaaaaaagcgaaacgtggtaagtgaaagaagcttcacaaagctgggtatgatcatttttgccccttcttgatatgattttcttttcttcttaattcttcagagaaggaagtattaacatcgtatattaaatgcagcatctagctttgtgttcacgtttttctaatttaacacattgcaattttagtccttcaaaactataaaaaaaatcttggattaacctcaaaggaaaaatgtatgtaggcaaatgaagtccatctaaagagagtatttctccaatatggtatcacttcagtgtcaaataatttcaccactcacaacactagtccagtgctaagaaatgagacccagaactagtgtccagatacatttgcacatacagatatacaaacacatacacatgcttacatatgtacacatatacatgtgtgcatgcatgcaaatacatacatgcgcaaatacatatatacatacacacacatatatacagatacgcacatgcatatacacaaatacatatataagtgtatgcatatatgcaaatagatacctacagaaatacatgcagatatacaatacataatgtatatacaaaaatatcatacatatgtatacatattactaaatacatactaagataataaggagagatgaaaatctttatccttattatctttattaatagaacgctttagaggactttcagatattctttatctttaatcatatccactagggcaaatgttgcctaaaagatacagagaacctggcttcttcccatttcacctctgctccttcctctctcatcctagaaggtgcttttccctatgctcagcacatcccttcagaacagacttagctggggatccatcccctccatgtccttcagccaattttcccggctctggactcacagactttctcagggctctgagaaggcctggctggtgccagcaattctctttgcccacatacttctcccctggccttgcctttattcaaatataagcattttcagggctggctcctctgtatgtctgcctctagaaataagataatttcttaacctcaaatgcttgttggtgttcatattagccctaggactaagacatcaggtgatattacagccccatcataatgctataaatgggatccacaaacttctattacatccaaatgaagagacgtgtttttgtgagatgaatggattgtgtagccaacgcccaggagttccagggagtttggaaaataattgccattggcaatatgtctgcagtcatactaccaaagagcgtattattgcagagtttcaccttcaatccacataggcttaaatagggacttcctatagctaagcaacctatgaacaaaataagacttactggaaaatgaacgtttgcaaaagaaggagggagcattcaatctggaaagcagaaactctagaaatattgtgaaagattggagcatggtagaaaaatgttaaagaaagaatagttatgtccacataatgaaaattagatttaaatgagccttgggagatcaagaatgtcaaccaacatcattttaaaacaactctgttttctcagtgccatgcagaataaacctcgaatgcatttgaaaggacaatgaactgggactctttgccctggcaaatgccatttaactgtttaagaaacaacatgcctgtgatgtgaatagcttcttattttcttctttaaagaatcgcttttttggctgggtgcagtggctcactccagtaatcccagcattttggcaggccgaggcaggtggatcacctgaggtcaggagttggagagcaggctggccaacatgatgaaaccctgtctctactaaaaatacaaaaagttagctgggtgtggtggtgtgcacctgcaatctcagctactcaggaggctgagacaagagaatcgcttgaacccgggagggggaggctgcagtgagctgagatcgcgccacggcactctagcctgggcaacaagagaaaaactccatcaaaaaaaaaaaaaaaagaagaagaagaatcactttttcttcccagtaggcttctttccttctttggagatgagcaaaaagtataaaaacatctgtggaaacctcctgtttgtatgttttacattggaatgggtgcaaaaaatacactcactattcctttacatccttctaagagggctgtttctactcttgacactcaatacttgtttttgtttctctaatcactgttatacgttactcacgaatattcatcaaaacccttttccttattttttatctagttttaaataattcatttgagataaaaagaagtttttctttgctttttttaatcactcagtggaggatgaacatgaagctgtaccaatggataggagaccgtctggtagagcacgggagccagggatagggatctgaagatggaagatgtgagtttcaagctgggctctgcccttgctctgggaatcacctgggtaaatcctttaaccctttcctgccccaagtgtgagctgagagcttgccagaaatgcagattccgagtctccagccctgctgagtcagaatctgctttgtaacaacttccccaggtgagctgggtgcctgctcacttcaacaagtgctgcattatccttttttgactctcaatttcttcaactataaaggtggtactgatggcaaccagctgccgagcagctctctcccaggacagttaaatgggccaaataatctagtgtgtgtaacaggtttcataaatcttaatattgtatttaaattatcatatgatagaagggtgatgtgactgactccaaacctctgcatgtgaaccatcagaattatccattctagtcatattattctaacaagccagatgcaaggaaaatcacagtctcttgtgtgcaaattatcacttattttttgtaagtactggattttcaaaccaagtatctacctaacagaggggaagggagatctagcatcttttacttcaagagcacgtctgtcactttgatttatagcctttttggtccctggtccagttcttttgtgggttttccattcaaattctacattagtttgtttaatgtcaattaaatcaaagctttgtgcaggaaggaatgaatcctggtacactccccagcgtgctgttggtattctctacataacaagataataaattaatagatataccatggtcttataacataatgttctttttctttctttctttctttctttctttttttttttttttacctagaatagcacaaggcacaaagttgatagccctcaaacttctgaagaaaagtcttttcttccaggatgtggaatccataatgctttctatgttaactttccctaaaaattgttgaatttttcataaacttctatgaggaagtgtttccatggcagtctggctaagaggttcacaccatcattctgtcctggtgatttttgaaacttacaagcccaggttgaaactcaggtgattcaaggcttgagaaacacaaaggccaagctcaaggagtagcaaagttgcttgcactttttttctattggcatggtccttctctgaacaccagggaaggggtggtgcaccacctctctcctcttcagaaggagctccgtgaaaaatcggcagttttatgcttggccctttcaaaacacacaaaggctaaaaatacagtgtgctacgcatctggaatgtgtctcatctgtgaatctctgacacatggattcattgttttcgataaaattccaggaattttattcatgagaaaattctggcacaatggaaaaccctggcaagcaaaagataggggcagcagatgtcctggcctccacccacaactctgtctctgcttttagctaattttcatcaggtgtcactctcatgccttcaaacactcaattcaaaatttcccataagacgggggtgagggggtgggggtgtcaaaacagccttaattttttaaataattggtacggtcccccccctccccacagacaggtgtgtcacaccaggttcaacatgcacgtgccaggatgcaggatgggcactttaagaagaagccgcaagaccacagggccactggccatggggctccaccactccgtgcccctcatgtaccaagtcttcaagctcctcgtctaaaatgagggtctggtctactgatgttttctaagactccattttgcaccaaaatgagatcgatttgtttaactagtaacatcctctttcagccatagccaggctgcagtctctacctcctccatctctgagcagacatgcagataaggtagaaatctaccatgtatggagttgctaaaaagttcctatgcatccaggttagatgctaactgcagggtctttccctgctgcccccagactttaattttcctcaatcttgtaggtatctccttctgtgctaatggtaagaagctagtcagcaccctgagagctagtgttatgtttttaagtgtggaaaggatctactctcttgcatgggaatatggcatctgttctacacataaagcacttcaataataataataaataaaaaaatttaaaaaataaaaaacacatggcaacatggtaataccaacagaaagtcttgtagaaactggggttctggcagacagaggagcacatgaataagtctccactattcacatgatggtccaggggtctccttcttttgctttctatccccatccccatcattgttggcatgggccacacactgtataacgcagacatgaacacagacgttttctttttcttagacgctgacttacgtagaaagagttagtcttcacccactgtgagggtccaatccctgccaaggtctttcttcagcttggtaagtgatgatgtctgactccctggggctgggatgctaagcctgtgcttttcagaagatttttccagcacataaatatatcctggttgctgcatggaaaggggactaagtagccaggtcatcagagccctttgctaatgttatacgctgagctcatgcttttcctatgacatagatgagcactgggtagaccccgtcctggtaacacttttcatgcactaacaagttggttgccagtgagacttgatttttatgactctgggagtgctgacctcaaaacctaatacatttgaactaggagagcaatccctccaacaatttcaaactacacatacttacatcacatccaatagggctcttttgccatctggcttgagcccctctataaatatgtctactttgaaagtcacaagcctgggcggggtggctcacacctgtaatcccagcactttgggaggtggaggcaggcagaccacgaggtcaggagatggaaaacatcctggctaacatggtgaaaccccatctctactaaaaatacaaaaaattagctgggcgtggtggcacatgcctgtagtcccagctactcaggaggctgaggcaggagaatcgcttgaacctgggggacagaggttgcagtgagccgagatcatgccactgcactctggcctgggcgaaagagcaagactctgtctcaaaaaaaaaaaaaaaagtcacaaatactctttgaaagtgtgcagagtcattcatatccaaaccatcaaggcctgcccaacagcctggtgacttgaaatcttgacgtgtacacagagtctaaacctcggtctttagattgcctccttactggacctctttacttattaagattcatccttgtggaggaagtgaggtcatggatgttcacatctatctttcccaggaagaaaaggaagcttcaagagctgggaaatgctatgcaccactgtgcaggttctgagcagcacagagccacctgtggggtgggcgggtaggtgagtagtggacatctgaccaccaggcgctgtgcaggactacctccttgcagagcaggtggggccttccaagttgcctactcatccaacctgcacagtaagccttatgggagcgtcatggggctacgcctacttcaaagagcaacttagctaaagggaaagagaatttgcacttgctctcttccactctagcagacttgcacttgtcgctatttatttgtgaacacagactcattttagattgacttaaaaataaaaaaaagtgcaaagaacagggcagctggaagttgggaaaccacttctgccactgctgaatctgaagccttaagctcctgaactggaaaaccagccgactggagcactgagctccctgggccctgtaaaagagcacactggccaggcatggtggctcgtgcctgtaatcccagcacttttggaggccaagacgggcagatcacgaggtcaggagttcgagaccagcctggccaacatggtgaaactctgtctctactaaaaatacaaatattagccaggtgtggtggcgtgtgcctgtaatcccagctactcggtaggccgaggctggagaatagcttgaacctgggaggtggaggttgcagtgagctgaggttgcgccactgcactccagcctgggtgacagagtgagactctggctcaaaaaaaaaaaaaaaaaaaagaatgcaccaagtagtggccagtcaggctcccatgggccttgacacgtgagatgtcaggcagaatttttattaatgaatctgatgccaattcagtatttctgcaatcacaatgcactttcgcaatatttatccaagcaatatttatccaacaaaaatatccaatatttatttatccaggatctcgcaaacgttcagtctagtttcactcacgtcagtgtctctaaccttcatactttgctttcaagcaagagtcgtgtgttggtctgggtgtccgaaggtgggggtggtagctggtgatgcaaggaaccaaaaattggccatacttacttacttaaatatttcacagctctttaacagattctcatctcctgctctcttctcttctccaaccttgccgtctggttctgacactgtcctgccacgattaggagtgagctttttggggttccctcaaacattcactcccagctggtctctttgttacctactcaagagcagttcatactgttggccactctccccttttttaaccctcttttctttggcttccatattcctgctattcctcctatttggttgacaattccatcccccatctctttatgccctcctttttctctcctcattctctaaatgtcagctttcctctgtgcactctcctgggccacttctctactaggctatcatttcttccaagccatcactcaggagccactccaatggcctcagcgctgccaggaagcgcagcgcatttaatttgaagggtgaaactgccttggagggatggcaggtgcatgcttaataacttgtttcccaaggccacataagtgtcattactggatgataattatcagctcaagagggaaagttctaagacagagaatgcaagatttctaaacaggtctaagacagttttccaatgtaagatttattatgtaacagttttgaaagtagtgtctgattccctgtctatatcctccagaacaatctgagggcatggttgccattacaatttactttgggggacgattttatagcacgtcttcacagacaacacgacaaacatctttgcttctgctacactgacaacctgaagttaacatttctgtacctatgtagccattttaatcaccccctaaactggttattccacagcccaggggtgtgggactgagtcagatgggctagagatacctttattcagaggatttagaagtttgcctcagagaaaggccatttctagtctccactagaaatcacacatatcttccaggaataagaatattctcttagtcataagttcaacaaatatgtactgaacaccttttctacttagaaacttgtctagctgcttctagattacatccatgacccaaaaccacaaagacacctatctgcataaggcttgtattctagcactacaagccacagataatttttgaaaatcaattaatcaaccaataattgatagggtaaatttataaccttgtttttcaagcctgatctcagggttagaaggtggtaagtgataagtatgaagaaacagaaggcagaactagagactcaggaaaagagaggtaaactgctgcttttcatttagagtggccagggtggtcctgagaaaacgcgaaggaggggagggtgtgagcccccatgcattcatgaagaataggccttccagccttggcaacagctagaacaaggccagagtggactgcgggggctgcacgaggaacaatgggaccaagaacagccagggaggaggggttactggaaaggagcgaaagaaagaaccaggaggtgaaccaggaaaggctgggggtggtagagccttgcaggccatggcaggaacctgggtgttgactcagagagaagtggagtctctctagccgtcttggctaaaagcccgggaattgtcttcttctgtgttgcactaatattttccatctcataagggttctgcaaagaaaattctttctatctttaaagttttattattttcaaaactaaatgtgatgagaatgcatatattgcatatgccatgtgtacaccaaaagccacacctaataaaatgttacagccatcctttgtcccacatgcaacgggaacttccattcatcatcacatgcagaaactctgggaactgagaatctgtacttttcattcagagtctgcaaggggtcacggccattttgaaaggctttgactcacacaggaaatacctcactgaggctcccacccacccatccactaatagggcagcctttagggaaactgacttgtggcaactgaaaggaataacggcaccaaagtattcccctgccctgaaatctctgtttacctgtggaccggtgatgggtgtgaggctgtaggttttaacgagctctgaatggcaaatggcagacaatggtgtcacttcctttctgcttaggaaggagacgtttggaaaaactgttcactgctgtgcttgcctatggagaacctggattcccagagctctatctggtagaacgtgtctccatattaataagcagtgaatcctcttttgcggctgaattttcctcaaggaagcagcatgggccttattactgccttaaaacccaatttcaatattcgatacatagtctgtgtattcatttgctagggttgccaagacaatgtaccacggactgaggggcttaagcaacagacatttattctctcatggctctggaagctggaagtcagagagcaaagtagcagcggggttgattcctcctgaggactccctccttagcttgtggatggtcatcttctccctgtctcttcatatcatcctccctctatgcatgcctgtttctgagtccaaattacctctttttataaggacatcagtcccactgaattaaggaccaccctaagggcctcattttaattggattacctctgtaaaggccctacctccaaataaggtcccactctgaggtcctgggggttaggacttcaacataactcagggaacactattcaacccataccatcctccaggaaggcagagaatgtgtccctcttcttcactgctgtatctccctgcctagcacagtgccaggtaccacactatgctctgtaggtcagtgattctccggagctctgtaggtcagtcattctcaaagtgttgtccaggaaccccctggggtccccagacccctctaagggcaggcataagcagatctgagaatccagctgcctccaattagcccagacattaaagagattgcaaaaaatgcaaaacaatgccacttctcattaacattttcttggaaaatagagttacttttcataaaaatatctcatttgtgttaacatgcaatgagtttatttatttatttttattttttgagatgaagtttcactcttgtcacccaggctggaatgcaatggtgtgatctcggctcactgcaacctccgcctcctgggttcaagtgattctcctgcctcagcctcctgaatagctgggattacaggcgtgtcccaccatgcctggctaatttttttttctttttctttttcttttttgagacggagtctcgccctgttgcccaggctggaatgcagtggcgcgatcttggctcactgcaaactctgcctcctgggttcatgccttctcctgcctcagcctcctgagtagctgggactacaggtacccgccaccacgcctggctaatttttttgtatttttagtagaaacagggtttcatgatattggctaggctggtcttgaactcctgacctcaggtgatctgcctgctttggcctcccaaagtgctgggattacagtcatgagccactgcacctggccttgttattgttatttttaaatgaatttataagtaaatgtttcaaaatttctgtttttgtttctaccaatagatataatgcatatacacaatttttttttaagaatcctcaaccaatcttaagaacgtaaaggggtcctgagaccaaaagattaagaatcactgccgtcgaggttttaagcttggctaggacacagtctgtacttactgaagtaacccacagtatgacagtaataagacactttatgaagaacatattttcagtagctaagtgtcatagaaaaggaagcttgttagccatttcctcaagttgacaacagagagtccttaggaaaataattttttaaagccaatattgagccttccaagactgcacatggtgatatgttaaatttggaatttatgcaacttaaaaaactgagagtcgggggttggcatttttgtgcatcctaactgacgagtgctgccccagggctctctaacactgcacacagtctactaaagaagcaggctgcccatcatgacccccacccatcagctacacagcacacatctgcttctagatgaaccttcttgcaagtggcctgtcttatggcaaaatcaaggggcaggcctgtaaagcggaccaggaaatgagcagcaactgcataccaccaacctgttgccaagctaactgtgcttttctggatcagaggcagcttgagacactggtccctggggctgagggactgcagagcccgggcacagactccctgcctatctcccagtgtgtccatcttggtacacctggtgcatctctggattggcaagtggcactccccaattaatgttaagggccacttgttttaaatataaccagattattttaatttttaaatgtgtatcccatacttggacactgaaaggtcctccctgtttacctgcttgctggggtctgtgcttgggtgtctcattttattataaaacagagtctcaaaggcatttaatactaagatcaagtggctgggcatccatcatgtgcagagcaggagcctgatggtggtgaaggctcattctgcatgtggttgactctaggaactactttaacagaggggaagaaatacactgggagaaaggagcaggagattcgtcagggctgggggaatactggctccatgagggcagagacttttttctattttttctctttttcagagcctgtaagtgtccacatatcatgcacatgcagtgcgtatttgttgcatgagctcctggtatgcaggtgccaaatgtcatgctaagtgtgtcgactggatgacagaagaaggaaggagggattaaaggaactggtgtgcactggcctgagccttgaagaatggggtgtactgggtaaatcaaaatggtggggagcatttccagatggagaaactgcaaggaaaagcatagaagtggggccacccctcgtgagctggggagggcccagggtatgtgtgctggttggggggaagctgaaactgaggaaattcccattggatccatagcctggttctggtttccacaggcctgggatgccccgtccagagtttgactttcagtctgcacgtaatccaggctttgtattcccacttcccgtatcccctcactcctttttcacacaccctttttatctatgatgctactggggtcatgggttaagaagtcctgtcgtctaagcagcaagggtgcatcaaagcaggattttctccattgattccaaggtgtgattcagaaatggtaaaaactccgaacactaggatgagcactggggatgggttcatgttttttttttatgaaataattcagaacttattaagaattcccttggcaaaccaaattaaatattaaacaactatttgttaatatgttactattggattctatcttagaaaagtgtaattatgtgtaactgaactttttgttttcttgtggttgaaccctgaattaccatgccttctggtttccgtgtttttcctggggaataggtcatatttcttacttccaaagcccagaaataaaagcctcacacatccatccgtagtcccaaaggcttttctgcctagtacccagagagtaacagcagtgcttcaaactatttgtggacaagaagtcctaaaacatcagacacactgtggaaagcaatttcatttcattaatacaattcataattaactgcatttattttattgtctaaattccaactgctaacctatcatatcgacgaattctttgaagttgcctttattctacaggatatgttcatttttagataatgctatttttcatatactttaagttctggggtacatgtgcagaacatgcaggtttgttacatagttatatacgtgccatggtagtttgctgcacccatcaacccatcatctacattaggtatttctcctaatgctatccctcacctaccctcctaccccccgagaggccctggtgtgtgatgttcccctccttgtgtccatgtattctcttgatcatctcccacttattagtgagaacatgtggtgtttggttttctgttcctgtgttagtttgctgagaatgatggtttccagcatcatccatgtccctgcaaaggacatgaactcatccttttttatggctgcatggtattccatggtgtatatgtgccacattttctttatccagtctattgttgatgagcatttgagttggttctgggttcatgttttaaaatctcaatttgctccctagtcctaggaatgatcttctccacctccaaggaatgcaagccccagtgcaacatggattcttcctctgtaagaggctagactccaaataatttgtcctgtttttgcctgtgggatgttacaagtgtaccctgctgtctgtaattgtgtttctgaagtgttctatgtaagtaggtttttgttagttgaattgtactttaaatgtgccaatcaagttccccatgaaaagagatgggcacagagactttttgaaaaattaagcatcccaagagaaaagccgatctgaaaagactacatattatatgattccaattatatgacattctggaaaaggcaagactacagagatactgaaagatcagtgtttgccaaagattagagggagggaggggtgaacaggtggagcactgagggtttttagggcagtgaaactattccgtataatcctataatgttggatacatgtaaatatacatttgtccaaacccacagaatgtccagcaccacaaatgaacgctaatgtaaactacaggcactgggtgataatgacctgtcaatataggttcatcaactgtagcaaatgcactccgatggggaatgttgataatgtgggcaaggctacgcaagtgtaggggcagcaggtgtatggaaatcactctatcttcctctcgggtttgctgcgtactaaaattgctctgagaaataaagtctattttttaaaaaatgaagtattccaattaatttataagttttgccacacgtgcaatgacggccctaaccactttactttggttctccgatactgaatatgtcactgtgaatatctcatcctccttgatcccatccccatcaaaactagagattgaaataaggagatgagatggccctccctgaccgccttgtgcctttcagaggaggtgcctgggctggaatggggaggagctaaggactcctgtgggattctgatgctgggtgtgaaactgtctgcagttagcacggtgttggagagatgagtgctagactttgtatttctggggactagtgataaatgctcattattatttatataattttaaagctacgtttaaatttgtccccagtactagagactttaatgttatattgaaataatacataataggctgcaaatagttatattcttgtcttgttgttgtccatgtatcagcattcttgtatgaatgaaactagaaccaagaagaaaatccatcactacaataatggtccatacattaaaacagtttaggctgtctgatggtctggggtgtgtgtgtgtgtgtgtgtgtgtgtgtgtgtgatatagatatgtatgatatatatgatgtatatatgatttatatatatataaatcatctcatcttgctcaaaacaatatcactcttatttaggtaggcacactggaatatgattttaattaattgaaaagtacagtttgtttcacatttgcaggagtggtttaattcctacacagtgtactaagatggcctctcgtgggctcatgatcctggaagatatactcccaaagtgagggggggtctatgttggaagcaaaaataaaaggaatttaaagaatgacaggtctgggaaattattcttatggatggtcagttcttcatatgataaaatagttatgacaaaccaaacaggcacagtctcatgtatgcactgatttgcatgaaccaactttacagataattgattcagttggttggaactacagtttcttccaaatgtggacaacttacaacagggtgggagccccaaactgtgaagtcatgtgaggtcatatacaaactgaaaaacagggtttctctactggaatgataatcctaccatgttacacttttccccaaaatgaaatccaacatctttcacctggcgtaagaagcccaacatgttctggcccctagaaacccttacatcctgcaaagagggactagagcttgttactcttattagctactcttaaagtcacagaggtagttaatttggcaaggagtggctacaaattcaagacatgtttggatgtgctgagaatcagaatccaatctcggccctcaagtcatgggttaaagacttggttttttatctatatgaggtcctaccttgtagttcaagcagaaacatccaacaaatgaaagcagaaacaacatttgacagctcaaattcaaaagcaagaggcttgtcaatgcaaaagtcttgtgctgcaaatgtttcaagggaagtatccatactctgaagtgtgcaattgaaagaatgacctgatattcttgcactgttgcctcaaacaaacctccctcctcctagctagctccggatcttttatgcatcatatagtacatcttcccaaaaaagcaggtggaaaccaaagtgtgcaaaaacacacattttccaagaacaaatgcattatactagcaagttatgtgtggtggggctaggtgcttctgcgggtgtggaggaggaggagagaaagaagggtcaggaggaagtgtgttgggtacagagacatggaaataagaaacaggaaccctgaaagacacacccgcggaggttctgtaactgtacatgtgctcttgttaaatcgccagtttcagaggactcagatctgaggccatatagaaatctattaatttgcatcttgactttggggcttccagtaacagtaagtatttgtatttcaggatccactcagcagaaaggccatacatattcaagtcacataataaattggtgaattccaagtgaattgtgaataccaaaaaagaaaactgattatgtgactttctggaatatgatgtagaaattgacctaacaaaatgtatatgcacacttacggcatgtgtgcatgagggtgtcatttatgtacacaggtcatgtgcacatccaactcatggccatgcatgctgtagcctgttacccattctgggagatatgtaagcctttgtctttctccctccagcttcctgccttcttaaaacatttcactggtcatcaaccaatgattgaagctgggtgcagaaaaggagaaaaggtgaaaactcctcttagtccacaaggtgacgtgttagtgcttcaagtgaaagggctgtggtggagagccagagaaagcccttaggtggaatgagactgtggttcctataggtcggcaccttcctccccacccggcaggtcagctcatcaattgcacttatctcccagctgccacagcctgtctcactcctttctctctcctgttgggctgctaccaggcctggtaaactattccgtagctctgtgcaatagaaaatagatatgtatttctctgaatatagagagggaaattggagttcacatggaatgcatactgtaaacttatttgttttctgaaagcaaaaattaaacttgaaaggagcaaagcttttcaaatttcccatagtgctggcctcaaatcctaaagatttttttccttgacaagaatcatgggatgaattggaagatctggatgctccattcaccacagttgatgatgctaaaacccatgtgacagcagaggaaagaattgaacattctaaagtcccctctggcaactggaatgccaggggagccttcaccatatacctcatcaagccaccccaacaaacctgccatgtcggtgaaaagaccatgctcactatgaaaatgtggcttctgccgggtgcggtggctcacgcctgtaatcccagcactttgggaggccgaggcaggcggatcacgaggtcaggagatcgagactatcttggctaacacggtgaaaccctgtctccactaaaaatacaaaaaattagccgggcgtggtggtgggcgcctgtagtcccagctactagggaggctgaggtaggagaatagcgtgaacccgggaggcggagcttgcagtgaaccaagatcgcgccactgcactccagcctgggagacagccagactctgtctcaaaaaaaaaaaaaaaaaaagaaaaaaaaaaaagaaaatgtggcttcaagaccagaactctagccctttgtccaaaaaaaaaccatagcccccgagacccctgatggccttgacatgccactgggggtccccttatctatttacattatagaagggcttctaagaagaatggtttcagtcagagaatccaagcaacttatgctaaagtccagcctcatcctcagaactctgggcatgcttgtttttaatgccatgtctatccatctgtgactcattaacgcacttagcaaacactgagtgactgactagtctatctctccccgtgataaaatttaaacgcctcttacaagacatgagtagtctacctacctgttacttgtatgccattacctgaaaaattcccatctgtttggatgcaaacttcacagaaactctgccacaaatgctcacgaacaccatcacatgggctgggctctagtgctttggaatatcctactttcttagaaaaatcgatgagtacatataaatataattagctgcaccttgattcctgcggaatcattgtattaactgctttgggctattctccttctttcctttcaggcaatattaatttgtaacaaacacattttatgatataataaattatctttcattttttactatcaaatacatggagaagtaaaaaaacaaaaaacccagaacttctaggcagctcttaaacaagtcttgctgttacttggaaaagtaacaaattcacaggtttattgtctatgttaataaagctgtgttggagtagtcattataaccttttacattccctcctgtttacagctcacagaatatgtttacacatgtgatctcattcagttgtaacatgatctgcataaattatgggtattaacacttgccatatttattacaacgatttccccagcaatttgtcttcttaattgtataatctatattgcaaacagatgtctgcagtttgtatatgcagctatgtactcctatggtttatgcatctacctcaggccattaaactgtaagctcctggagggcagggatgtatctgattcatttctgtatctccggaacccactgcacagctgctgaatggatacacatctagttacttaacctctgtgtccttcagtttcctcatctgtgaaatggctataatgattgcaggaacctgtcttctctgtcccaattgtattaagcaaaacacttaatacaatgtctagcatataataagcactctatgagtgttttctattattattattattattattattgttataattatctggagttaattgaattaaagttcaaaaagatgacctaactcatttgggggaaggtgatgaataaacggcagaaagaaaggaatatcagggatcttatatgctgatcctagctttgtctaatctgccaagctaagtcgtaagatttttctcttttcaaaatacttctgttaagctagtaaaaattatttacttgtaaagattccatgtgctgctttttctgtcataattgcatttaccttaccaaatacatattgaccatctacacagtggatagcagaggggccacagaaatgagtaaagtctagttcactctgcactggtatctcttttcttccatatttacattttataattacatttgtcaaactgcttcacaggcgaagtcctggaccaggaaccaaataaaattgacccagctttccgaccatggaaaactaaaagtataatcaactttggcaccattaaattctgtttcatttattttttccaagagtctattaacattgtcatacagaagtagaagatttaattgagtgtgtgcattttgagttgaaagcagatactaacaagaaaagctaacctggaagacatcttgtaaactgtttcatcagactggaccaggagccaggggagggtcgaggtgactcagggctgttggcaaagctgcagaaattgccactgggtttctctgtcctctaggcaacctaggctgcattggctctctggcctattattcattacggtttagttcaccacagaggttgccagtgagcagtgcataagattagagattttgtaaaaacatgttaatttgtatgaagacgaaaattggactatggagtttagtgataaaaatagataaacagttctgtcatttgatttaaatattaaaataagacaagacaaagcttttaaggaaatgaccacttcttggttctcaactagaggcaatgcctcttctgtcctgagcagatgggtgtttgggaatacgtggggtgacttgggttgctgtgataatgcaggggttctctggcaatcagagggagagggaggggcaccttcaaactgtggtccagatctacacaatcaggaaaggctgttcacctaaaattcaaccttctgttgagaagagcaacacttacggagctcatcaaagaacgacaaaccactggaacagttcttgagaccaaagtctcattcactctgggacatatccagttacataaatcatttatgttttatcccgtctctactttcccaagaaaccctgccacacattcatagtgaatatcaaacctaattaaagatcctaagcagctgagaaaattactcaatgaccaaactataattagtcttctacaagggagaaaatgtattcaaatcattgcttaattttgtttcatttcctcttacctgcacttgaccattaagatcaaaagtctgagaatttgtggccaaaaaaaatgaacatgagtcaaagtcacatctatttgttaataatggaaagtaattccttttctaattacacgtgaaaatactagtatccaacaaacctatttgtggaaaatacggtttagattgggaaggttaattactttcaggtttttcaatgtccaaaacacacctcagaactaacaggctcagacaagatctttatgagatcactggatcctccctccaaaagcttccccctcccctgttgatctctattccatatgctgcttcatttgatcgtatagcgtgtatgatgagcctgaatgcgggcatttgttgatttgagtattacctgaaacaaaagatacaccagaatgtaaaacccaggagggcagagactgttttcccagaacctagaacaactcctggcacataccagatgtaaaatcattgtagaaagaaagaaagaaagaatgaaagaaaggaaggaaggaaggaaggcatgaaacggtgcactattattgtatgccaccttaagtcactcatagaaaatactgcatgccagcactctatgcaatgggtgttacactagccattatgtaaagtcaatgacgggattatacgctgggcactttataatttaataaacacccttcaattaccgtctcatttgctcctccatgccactccacatagtatacgggacatattttaggatcaccagtttagagataaagacagaggttgtgtccccaaagtttgcttgcgagtgtggtatttgtaacttctaaaactctaactctcccctgaaaacacgtcctaagagtggtgaggctcccacgtgaggtggcaatattggttacccccgctgagctcatcacattgcgcaggcctccacagggcagctacactctacgataaggaacatgaagccctgagagtcaggagggagaaaaaagaaaatgaacgtttggaaaagggcattcccaaatcacaggagaaggggaagaaacgtgtctcagctactaagtttctcttttccatgacgctcaaagcagaaaatggctgcacgtgggcaattcgtgcgcttggagctcagacctgcagtcttgtcgtttgtctgccctgtcttggtgcatgctgggcctgacttttttatttttccatttcaaggagccccagcagggcctggaggaaatgagttttgcagcccatctcggcccttgagcttggctcctcggctgacctcggctccccgcctgcagacccggcatgaggcaggcagcaggcactgcggggcagaacttccgggacctgcaagaccagtccgctgccttctgagacgtagttctgaggtgtagcaagttttcattttcacagcataaaaccgtctacaaatacatacttcaaaatgaaatggaggatgcgctcaaaaaaaaaaaaaaaaaaaaggcttagagacacgtcaaaagggcacaggagctcagccaggtcaaataaattcccaaatttgactcacatcacttcagcctcatctggatattacccacactctgcctaggcaggcgaagcttccgtgggatcctctgtctttagtgaattctttcctttatcttgtccagcttttcattgctctttcagaaactgagcccatggttttaaatcttaatatgaccttgcattcaattatatatatacatatatatatatatacaaagctgttttttaaagacaattttaaataagaaaaaaataattattttagataccagagagtggtgaaataataatgattcaaacttaatcctcacttcacgtaggggaaattgactcaaatctgggagcatcaaaaattaagatgcatttacaaatcctaggagaagatatcctttgtaatctcagagaaaataattgagagagggaaaattttttttgaaagacgtggtttggacatattactattttgtgaaatgaagttaaatgtatggtacagatattaaagttcacttaagttttatctatataaagtgtgtgattttggatctaaacaggcataaatatatatatgtgtgtgtgtgtgtatgtgtacatgtttgcgtacgtatgcatgtgtatgtgtacatgtttgcgtatgtatgcatgtgtatgtgtgagcgtatgtgtgtgtaagtgttgtatatgtgtgtatgtgtgtgtatatgtatgtgtgtatataataggaagtaagttggaaaacatgagccaactgacttttttttccttagacagctaaagaagagtggttagaagtttactcacaagtaaatcttttaaggagcgtttacttcccagaaacagcaatgagatcttggaggggcaattcttgtcaactgtgcatcatcaatggagtttaactgtgagaggtaaaacccattgttggtcccgactccaccaacccaaatggtcatatctgaggacttcctgtggttctcccgcccccaccctctccacggcatttactgctcctgtataccctggacttctcgacaggaaatggcaaattcctcagtaggaaagccaagaagtgggaggtcacatggagactggaagttcattgcgtgcagcccctccaggtgacaggcgacaccgcctctgcatgttgagtgcctttgtgacacatgatctccttgtctcatgaccacaggcagcagggtcctgatgagtgccctggagagaactgtcctcccacccctgggtgacacagagtctcagaagccagcagaggtgctgcaccaaaggctcagactttcaccctgcctctcttctcctcaactctttgccctaaaaaacatgtgctttgagggtgtgttgaaaatctcactaagtcaaatgatgcctgtggggcagaaataacccttgctctgaaagggtcaccaaaaagtcatgagactcctacctgtatggaaggtggtgactatatagcccttgtataaacaaacaaatacggtgaaagacttggctccatttttttttttttgtctgttcgttattttttggagaaaacgttgtgataagaagcctttagcctacaaaaatgtctctagattaatgataatttatctcacttttctcagtgaaacagatgaatcaaagaaagtgaagcatcgtagacaatataggaccttcctgataacatctaacatttaataacgtgatcacagcgtggcggctctaaaagacatgcacatgtgaattaatgcatctaacctgcacactagctaccattatgcccattttaaagatgaggaaaactgagactccaaaaattaaataagttgcctagagcatcttgccagttaatgcaccagaattctaagccagctgcctggttccaaagcgcatgcccataaacgcggaacataatgcaccaaatggcctagaactgaaacgactgcaaaaataagtcaacatatgagaaactagagaatatataaagccagccccaccataatcagtggcaagggatgggagatgggaagaagggagaagggaagggaagctaaataatttcagtttttctctgtgcctttaattcctgtcccctgaagatgacacgctcattttagtagcaacccatgaccaagatgcattccccaagcttttcgcacctgacagaaagggactcggtgtccaggactgtgcccgattacaatcaaagcagatggacccttccttagggtagggctgttcttctgacagcctcctctgtgaaactagattataagaggatgtgctgctctcagacaccctctgcctgtccccgccttggggtccttgcctttgccattcccctggtccgcatcactcctccgaggcatttgcaaaccttgttctcaccttttctttgggtctctgtctgacaggccttgcctgatcatgttctctaaactagaggtcccgccccccggccacctggctctatcatgttccctaccttccctcctaaggctcctgacttcctgccacactctgtcttcgttgagctgtgatctatttgtcagtctcccccatctgcatccccctgattgacagcactgagtgagcccagctgtcctgctgctcatgcccctcagcacccatgagcctagtgggtgcccagtaaatccttagtgagtaaatgaatgagtcaatttccacacaccaaatcccaaagggataaaaagacattgcctttctgccatttcttggaagaattttttgagacaaactaaagaaaggaagctacttgttattaaatttttaaaaatctgcctactattttcaggcaaatatgtcatgatgacatctatgaaatctctgaaattaaagagaagcctgacgtttcacaggaattaaatgaagttgctgcatcacaggtgctccctgccacagggctccgtgtggcagcagcaaacagaactcctcgctgcttaggtgtagtccttaggaatgaaaatctgaacgtagtacgttaaaaaaaaaaatcttcaaaagcaaacaaagccctaagtgtcgctgtgtattatcagggcagggtcctcctcagagagaggcgggctgcaatcgcccctacacctttcaccaagtgcctcgcttcaggggtcccattgtctccacgtttaggtttaggagcctggctcttcgtaacaccagcgaaacatgttctcctaaagatgttccctgagatacaacaccactccgcattgtttcaccacataccagcattaatatcccagagtaatccaccctcctcttaacggctgatgacggctccaatggccatgcaaaaatcagttgaaggaaagggaagtcttgtcggaaatgagattagtcttgtaacgagtgttcagccctgataacccatctgggcacagaactgcttaaactggagagcaattaaccttcacccgacaagctctgtccaaccgttataaacattaaagagacagaatccttcccccctccttgtagactaaacaaccagatttgaaattccacgtaaacggcctctttctgcagatgtgcaccaacaacaacgtttagggggaaaaggtgggcaatggctctgttcataactctggtaacttttggccttggtgtgagtgggctgaggttattagcgtaaaaattaactggaggtatttccaataaaatcaccaggtttaggggactggacatagttgctttcatgcagaaacccatgtgtcctataggaacacaacttgatgcttgagagattcttttttcttttctttctttcctttttttttttttttttttttttgagacagagtctcactctgtcgcccaggctggattgcactggtgcgctcatggctcactgcaaccttgacctccccaggctcaggtaatcctcctacctccacctcccaagtagctgggaccgcaggcgaaggccaccatgccccactaatttttctgttttttgtagagacaaggtttcaccatgttggctaggttggtctcgctcaagcgatccacccaccttggcctcccaaaatgttgggatgacaggcgtgagtcactgcgcctggacttcttttttcaacagtagaaatatttgcactgggctagactctcactcactcccaattcctctcttccgacatttgcatgagtgatgctgcttgtggtcacagaagggagattttttttttaatctccgagaagttattggttttcatggggagcaaacctgtgatcttgcctttatcagcatttgccgtaaccagtcgagttaaccaagttgggccatgtgaaataccgagtggttagagaatctaccaggaaacctactgttaaaaataactttcacaacactgaagagaaatagctgaggtcacttaatttatcactcaggcatgagctttctttagcatcagttcatgctgagccattggcttgtttatggacatgatactaacaataaataggtaaagggtaagggccctatgacatagagctggctacaaaccaatgtggggtacacaatatgcctagcatttaaacaagaaaaaaatgtaaagtacatgcagaaagtcatatgagggaaccaaacctctatgttactgacctgttaatgtgactgcaactcagatttttttaaatagaaagaaaaaaggaaaacatatatttagcatgtcctaaacaaatttatctccccaaggttttagtgcaatcttcatgatgacctgagatagctatcaaaatagtccatcctaacattcgatcttatctctcccttgaacccagtttctctttttccagtaggtaagtcataatactccaggcctcagagacgtgtttgcacacaacgaggctgagcctatctcacttataaggatgacatatctcactcatgctggactccagaccggccccaataacagttttggagagtggcatggtagaggatgtgtgttacatgggaagtactactgtaccctgggacaagatatcctggcaacaggtcttgttttcatggtttgcatttacatgcttaactgttccttttcctgcctttgtaagactaagaaaatccttactgtacagagaaggaactgtgaaaatagagcaagtgggactgactctcacattgcagggatatgcaccatctccatttttgcagccaaattagatgcaagcccaggattccactggcctggttctcccaggaacactgggagtttcttggtgtcttagcttgaggtgaggtgaagatgggctatgggcacgtgagctgaccagtttttcatcctgtgtgcattggacgtagacaagggcacacacagacatgacaagaatccatgacctagctcctaatgtaaatcttctttcccaagacaatcttgcagagccctcatggtcagtgataagaggaacttcaatttttatttggaatctgacccatttcataagaatgagtaacacctgaatatttaggtgcagatatcaaagacagaagacaaaaagaaatcatagtgtttgacaataatattagtataggatgccgttttatgagttcagtcttaggactgtgtaggtgcaacgtgaagactttcctgaagacagccacatgaatcatttttcataggatgtaatcaccactgtcatccattagtccaggcttgacacatagaatgggggtgactggctgcctaagtaacaaactccccacgtgtgcttctgacgaactgtgtgggctgccctaagcttttgcatgtctcgacacttaccaagtaaaatgatgagataaggaaaaccacaacatcatactcagtatcttgtgaaactgaaatggttgcagagtaaacactttgccttacagtgattttattttgactattatgctggatttaacaatataatggttaatatccatgctataaagttttattttttcatcaacaaaactaattgcattggcactttcaaaatgttgtttgcacataaatgatttatacttaagtatgagtgtaacaatcttgccatcaggacctggtctgttgggagatatcagtgaatggagcctggctcttccaatgggcaaccgttgtttgttggtgaagctgccacccttgagacctgcctggtctccttcccacctgtagctggctaagtagtgtctccccacaattcacgtccacctggaacctcagaatatgaccttatttagaagtaggatctttgcagatgtaattaatgattaaaatgagatcatagattagggtaggttctaaatccagtgagagcatcctcataagaggctgagcaggacacacagaaacataaagaagaaggtcgtgggatgacaaaagcagagacggaagggatgcatctacagcagtctccccttatccacgggggacacactacaagacccccaggggatgtctgaaacctcagacaggactgaacccaactgccattaactggaacactttctgttccatccacaaatgcaataccttttccatcttaactaagcacttactatccactgtggtcatcagttttgcagtttgaggtgcaacggcaaaacaagcacagatttctttttatttcttcaaacttcaaagacagaagattcattcttactgtacatcttagcaaccacagcatatgatctttttccttgtaagtacagaactttcaccttttcactgaaagaaagcactttacggcttctctttaacatacccggaattgccaggatcagtcctcttgtgccttggggctactactgaataaaagaagggctacctacacataagcactgtgataccgtgacagtcgatcccataaccaagagggctactcggtgactaacaggcaggtagcatctgtagcatggatacggtggacaaaaggggaattcatgtcctgggtggagcagggcaggatggtacaagacttcatcatgctacttagcatggtgaacaatttaagacgtatgattcatttatttctagaaatggccatctaatatcttcagacagcagatgaaactgccagaaaccatggaaagtggaatcgcggataagagaggactactgtccaagccaaggaacacagggcttgcaggcaacccccggagctggaggaggcaccagatgcatccttcctcacagcctccagaagggaccaacccagccaacacctcgattttggatttctggactcccaagctataacagaataaatttctcttgctttaagccactaggttgtaataatttgtcacagctatcctgagaaactggtaacagtacttgtggatgctgtttttaacaaaaattttgccactttagggcactatatggcctttttttttttttttttttttttgccttatagagttaggtcaatttccaaaagtgctggagtttatgccaagaattaagtgactccctggttgcagtggccaaatagcctgaaattttcaaagtaatactaattttgcaaaacttttcatgtaaactcctttgcctgaccatgccctaatttttgtgattaggaaaatctggctcttatcccactggaggaaaagtgtctagttcatattctaatggaaatcatcacttgggaggtgttttgacaaacatctctcagttttgtttaaaaattatgttagaaattaagaaaaataacgaatggaaaacaaaatctaatttttggtatattttcctgctaacatttgtgggcaaattagttaaattatgattgtttcatgcatacttactcctccaacagcatcctagctctcttaggagttccttttaattatcctaaaaacagttaagagtatactgagccaaaatataattaggttgagaaacaatgaactcctaaatgaccaatcaagttttttccaacattttaattctcaaataaaggtcatttccttttatttgactccttaaaaactagattatagttcttctaggagaggaaccaagtcagatttcttttaatcacatacattgccaaatgcatgctttactcagggaaagatttcaatatgcatcatttattcatgcattcattcattcaggaaacagagtagcactttacatgcggacgctgtggaaacaatggtgatatgaattcttaaatgattaaagaaacagtccactaaaaatcttatcaagataatagaatacttcagattttatgaaagattacattttcattggcctatatataatgttttaaccagtaaggctcactaagttaaataatatgctggataatcttaaatttacagaagggttttcagttttactatttggcttagataagctggtagttacttgctaaaattaatctttattataaagcagatcatcttgaaactgaatacaaaaacaaacgtagctattattgaaaatgttatgctatctcatatccattagagatgttatttatataataagtactgtgttgtaatttgcctgattccaatgaatacagaaaccctcagtgtgaatcaatatactagacaccagcagacatatttaaaagattgctacagtttcactgacatttcaaagaggtgactgtagtaacaaaagaagaaaaatgaatagtccctatcatagcacattaatacaacttgtcactagttcatgtccagaaagacttattatataatagattgtcaaagttgaatatttcaatgacccaatgcaaatcctggataaatgctggtaggtgttgctgctcaataaaaatgaaagtggtgtttggttttgctcatcaaggcaagtgtcatgtagcaaaatgcaggctatgggttgcctggaaactgtattcctgcttttaatttacaagtgaaacattcccatccatggcctggaagggaccatcatgtactcggcagcactcattagattctgggcagcccccggtcatctgaccttcccaaacatagggaaaggacgtggatagacattttcccaaaaagacataataatgaacaatgggtatacgacaaggtgcccaatatcactaatcatcaggaaaatgcaaatcaaagacacaatgaggtatcacctcacgcctgttcagatggctatggtcaaaaagacaagaaatagtaagtgttggcgagaatgtgagaaaagggaatccttgcagactgttggtgggaacatggaatgttgcagacactgtggaaaaaagtatggaggttcctaaagaaattaaaaatagacctaccatatgacccagcaatcccttttctgggtactttcccaaagaaatgtaatcactatctcgtaaagatacccgcagtgccatattcattgcagcattactcacaatagccaagatatgaaaggaaccaaagtgtccatcaatggatgaatacataaaataaattgtggtggatatatacaacggaatatcatttagccttttttttttttgagatggaatctcagtctgttgcccaggctggagtgcagtggcatgatctcgactgactgcaacctctgcctcccaggttcaagtgattctcctgtcttagcctcccacatagctaggattacaggcacccacgaccacaccccactaattattaaatttttagtagagacgggctttcaccatgttggccaggctggtctcgaactcctggcctcaagtgatccacctaccgtggcctcacaaagtgttgggattacaagcgtagccaccatgcccggcccatttagctttcaaaaagagattctgccaattgccacattatggatgaatctggaggacgttatgctaagtgaaataagccacacacagaaagacaaatactgcatgatctcacttatatgtaaaatctataacaaacaaacaaacaaagactcaatggggaaatggggagatgtaggtcaaagaatataaagtagcaaatatgcagggtgaacaagtctagagatctaacgtacaccataagggatatgcttaataataccgtgctgtgctgtacttgggatttttgctttaagagtagattttaggtgctcttgccccacaaaaaaagaatgtgtaaccatgtaagatgatggatatgttaatttgccttcactatcagaaccttatcaccatcttcatgtatatcaaaacatcatgttgtacaccttaaatatataaaataaaacttttaaaaaataaatcaaaaagtcatagttcaaaccactcttttggaaaagtatggatttgttaatataagtggtatataacaattgtatatgcatctggggaaaatggactccatctttcatgatataaaaagcaattctcggccaggcatggtggctcacgcctataatcccagcactttgggaggctgaggcaggtggatcacgaggtcaggagattgagaccatcctggctaacacggtgaaaccccgtctctactaaaaatacaaacaaacaaacaaacaaaaaatagccgggcatggtggcacacgtctgtagtcccagctactcgggaggctgaggcaggggaatctcttgaaccccgggagagggtggaggttgcagtgagccaagattgcaccacagcattccagcctgggcgacagagtgagactctgtctcaaaaaaataaaaaatttttaaaaaacagcaattctttgtgattttaatatagggtgccagccacatcactgattcatgcactcactcatgcatttgtcatgcaggaagttatttattcatttatgaaatggacatttactgatagcctgctttttaataggcaccatcagcatgactgaaaggttacatgacaacagccacagaacttaaggcatagaactttaacaacacacgttttgagttactggtcttgacgcctggctaattttttgtattttagtagagatggggtttcactgtgttgcccaggctggtcgtgaactcctgagctcagacaatccacccgcctcaacctcccaaagtgctgcaattacatgtgtgagccaccgcgcccggtcggggttctatagattcttaatcatgattaaccagcaatatgataattcaatagatccctgctcacctcccctaaagaatgtgccactctaagtagttggttcaaaatagcttgactttttaacctctagatccactccagagaacagtggtctctccccattgcacaaacacattcatttatttaacagcatcacccaaagcataagaatgggaggaaacaatgaacgtccttcatttctccaactttaaattatcaaaactactgattttctgggctcacaaaaatgcagttgagttcagctgttgaaagtttggttaacatgtcagttgagccaccaaatggaataacagttgtaactctcttatgttttctctactgtcctcaaaggaatagcatgagaacaaagcaattagcatacattcaggagttgcataatgatgttttggacaatgacagactgcagataggacgagggtaccataagattataatggagctgaaaaatctctatggcctagtgacatacagctgtagtaacactgtagcacaatgcatttctcacatgtttttggtggtgctggtgtacaaacctactgtgttgccagttgtataaagtatagcacatacaattctgtacagtacataatagttgataatgataatagttgactatgttattggtttacatatttactataccatacttttcatcattattttagagtgtactttttctatttccaaaaaaaaaaaaagttaattgtaaaacagcctcaggcaggtccttcaagaaggattccaaaataaggcactgttatcgtaggagatgacagctccacacagattattgtccctgcagaccttccagtggcacagggacaagatgtagagatgaaaaacagtgatattgatgatcctgaccctgtgtagacctacgctaatgtatgtgtttgtgtcttagtttttaataaaaagtttagaaagttaaaaaaaaaatagaacaaagcttattgagtaaggatataaagaatgaaaatatttctgtacaactgaaccacatatttgtgtttcaagctaagtgagtacaaaagagtcaaaaagtttaaaaaattaataagtaaaaaaagttatagtaatctaatatgaatttactattgaagaaatgttttaataaatttagtgtaaatatacagtctttttttttttttttttgagatggagtctcgctgtgtcaccagactagagtgctgtggcgcaatctcagctcactgcaacctccaactccctggttcaagggattctcctccctccgcctcccaagtagctgggattacaggcatgcgccaccatgcccggctaatttttgtatttttagtagagatggggtttcactatgttggccaggatggtctcgatctcctgacctcgtgatccgcccacctcggcctcccaaagtgctgggattacaggcatgagccaccgcgcctggccaatatacagtgtttataagtctacagtagtagatagtgatgtcctaggctttcacattcactaaccactcactgattcacccagatccacagccactttccatcctgcaagctccattcatggtaagtgccttatacaggtgtacaggtgtatcatttttttcccttcttaataataataattattattattttgagatggggtctcgctctgtagcccaggctggagtgcagaggcatgatctcagctcacagcaacctttgcctcccaggttcaagcaattctcctgcctcagcctcctgagtagctgggactacaggtgcgtgccaccatgcctggctaattttttatatttttagtagagacgggatttcactgtgttagccaggatggtctccatctcctgacctcgtgatctgcccgcctcagcctcccaaagtgctgggattacaggtgtgagccaccgcacctggcctctactgcattattactatacctttcccacattttgatacataaaaaccattgtgttaagtgtcacaattgcctacagtattcagcctggtcacatgctgcacaggtttgtagcctaggagcacaggctacacttatagcctgtagcctacgtgtgcagccggctatgccatgtacatttgtgtaagtgctctttgtgatgtttgcacgatgaaatcatctaacaactcatttctcagaactgaccgggcatggtgatgcatgactgtgtagggaaatactttcacccctttagaagaagctataaataaccaggtataaatgcaggattcctttccaaagacaaatactggaaacaaacacaatcaaggaagataattgattacttcaaaaaaacaattgagatatgagagtaaattaaataagaagactgtgactaggataagtaaccaataacagcccataacagctaacattattattattgttgttattattatgagatgaggtattttgccaggttgcccaggctgacctcagatactgaggctcaagagatcctttgctttggcttcccgagaagctgaaactacaggcagctgccagcatgcctggtctgcaatttacatcttttgtacactacagcacgttactgttcaaagcacatacaagtattaagctgcttaatccttgcaacactaccaagaagtaggagttattatcatgactgactctcttctacagatgaggaaacgaggcacagggaagtgaaaggcgtggtgggacagggacctgcggtctggatctgcttcatatagagaaactgggttcttaagaaggaaaatgggccttaatttctaaatcgtaacaagttcagccctcactcctcttttttttttttttttcactatcctggaaaaaaaaaagaagtggatagaaaggtactaataacaatgagtttaatttctcaaattttattattctttaaaaaggatacattggtacaggagtaaagacaaaaaaaatcaaaaaagaatcgagtattcaaagacccttgatggtgtaacatcaattattttaattttgtttttaaaatttttattttctaaactcctataataattgtttttcaaatggggaaaaagaacgaagtttttattactgcctttctttctacaatatattattcaatggagatactgaacctgtatttgctacaggctaaagaaaataaaataaaacaatccctagccaggcaagggagattttcagagaggatgccaacagggtcctatcccatcaggcatccatgacaaatctgtctgctgtctggtcctgtagcatcacccaaatgtggttcaggcagcactggaaacaatacagactcaggagatcagggaagtcattttgcaaagaagcagaagtgtcaggaggtagcacctgtaaggatgaatgctggagctgtctcatggagtttcacagaaaggtaacaagctgcacaatgactgtctaggggcaacagatacataggaggaaagcagtcttcattcaaacaggatactgagattgacatagtgtgtcttccaacaagataagcaaaagtatgtgaagaaatgagtccctaaaggaaaatatctctttgggcaatttcacttcaattcaatttcatgttaaatacaaaatacatatattgaatatgtggataaaatcactagaatatattcgtgcaataacatctacgtgagacatgacagcatctcaccatgtctggcagtctctcggggtcaaatgcaatctctgccccccacctggcagtcatcggcacttatggaataggccaggcagaaggctctgttagatactgccttcttcccttcgcaatgcactgtcccagacttcctggggtgagagaagtgattgtctatgagagctagcttggagtgaatgaaaacagcatttaagaggctcagcattttctgatcgccaaagggggtacccttcaacatgaggtgacccagcaatgattggctgctgagttctttgagtattttagggacctgcaggagatctgggtggagctgtgggtttccgtgtgtacagtgtgtaaacatcaccctttggtgcttcgccagtgcttaaggggctcccaggtgctatttattttgtttagtttattgttcagtgttattgtttgttgacttgatctatttttttttctcctacaaaggggccagtctgcaaggacacatcctgtagatggctaattgatgatgccctattgtttagtgtgtgtgcactgtggttttatttgcttcggttcaaagggcctaaacaatgcattcgttggaatttagtaactgctgtaaaatcagcacagagaacaatctgtgagctgatattttttgtacccaaatctggtaatctctgcttgactaaagaaagcaaaatctaaaatgacctttcaactaaccatagaaaaggccttccattgaatctcaaagagacttatttttctaccaaatataaaaacattcgaattatgcatcattttccatgattcaaaggagacagaggtgcctacggggcatgttactcatagacaagtctattctagtctaatcacgtccccttaaaaatcaccgagtagatgacaccgaggatgagaacgaggtactgtaatcattactttagaaactttatatttttacctgtttcaagacagaattctcctagaaaatctggagcaacaagcttattccccttggagaggagataacgaataatggaccacgcattcggagagaggaagtttccactgggagcccttcctgcatcagtgcgtctctggttgggctggctatctgtgtaggaagtgaacgcaggaagtatctgtctacaaaccctttatcctcaaggtaattgctgtagcagcattttactgtttaccaaagcagtaaacatgtgatctaaaaaaagatgttttccatctccagaagaacaaggctttaaaaaatgtatacatgtgcttattttgtaaccagcttatcaaaattggttacaataggcttgggctttcaacagtgagtccatgaaaacagctcttgggatggacagaggtaccctcacagggatgcacaagaaacaaagaagtggcttccttcactagaatgctatcctagcaacacacattttatgtcttttctcctaagaccggcttaaccgagttcatactgtttggcttacaaagaaggtaaagtcaacaaaactatctatgttaattcaggttggtagaatgagtaattcacaaagtccaataactcataaaagtcacttacatttggccttggacaatattcttatttttacgtgactataaatatgcttccagtttaggagttcacacaagacaaagtgaaaagttagaactcaaaaggagatgtgtagtggctgcttttgctgacttttgcctggcgtaggccaagcctcctggtccgtcttttcctttgtttctttattccagatcaagcttgcaaacctgcaccgtcccagatttcctggggtaagagaagtgattgtctaggagaggcagcttggaatgaataaaaacaggtccaggaaggatccctcagcatttaagaggctcaggaggggtccccctcatcatccttgttgtcttttgtgtttttcaagccgccttccaggtggatagcgattgcaatgagagagaaagagtatggaaggagaataagaagaatagggagacacagaagttaacaacgccctgaatgtctccttccaggacctgctgtgcagtgtccggtgaactcaccagcaagcatttcccagccctgttttaagcaatctccaatgcagatcaggtgctcgtgaataattgggagctcactgtgtctgtcagagttcttactttataatgaagagataaaaacatgttcatcacaggaaaatggacaaattggctaattgaaaacaaaattcaattcacaaactgttgtagaaattgaaaaaaaaaaggtagggggaaatgcttttcatagattccctgattttagtcttagaagaaaaatgtatttggcttgaatgaatagtaaaattaactaactttgattgaggagcttatgtgtgccatatacagttctgggctcttgcgacttggtgaatctcactataaccctgtgaagtaggaactatcactctacccatttcaccgatggaaaagcctatctcctgtgaggctgtggcttgccaaaggtgaaatggccaggaagtagaacagccagggagtgaaccccaaaagccaggtgggagcccatttcccctgcccactgcacgagacccctccccggtttgaagatccgataggggcactgctgttagctccccctgcgtcctggcagcagcacagtcagcagatggtcactgtggagaaggcggagctgaccacctccattttcctataagggagctagggccaggagaggtgcgttcacctggggaagtcctgcagcatcaaactaaagctccgggccaccctctcccagatgggcctctttccacttccccttgccagcagctatatctatgcctcccatccgttgcacggaagataaggccaatcccttttccacagaggctattttaaggatgccacgaagaaatacagagtaccaagtgcctccctgggccaaagataaaagtgggctgtgctctctggattcaaccttcatgtttttgatgctctctggaaggtcagggaaggcacacatatcgtatggatccaaagaggactacgcaatgcaaaaccacatactttttttttctttttaacttggagcaatgtcttgggacatctacctcaaattgagacacaaactaattgtgttgacagattctaaagtgttgtttcaacagtttcttcttcctcaaaggtgagcatcatgtgcacactgtcaaaattaaaaaaaaaaaaaaaaagacccaataaaacccgatgaaacccaaagagcatggagatgagaaactcactgctggctgacgatctgaatgaatggccttggggggaatgtgaatgtggaggtagcagaagggtcctgtcttcagtgcttgattctgtatcaatacttggtaaatttaaaaaacaaaaaaaccagcaagggagattttaaatcatcaaggcagaaggatttaaaaagtggaatgtgttaaatgcaagagtgcgggatctttgcataaagttattatattttcaaaaattcgacaagcattgtttttaccaaacgtgtttaaagtaacagccctgaggttaatgttatgattggattctgatgtggcactttaaaaataaatcattttgcttggccttagcatttcttttcaaaatgtctctgtacttatctgtgtacaacagcagattaccgttcttcccagagtttaattccatgaacaccctgctgaaagacttgttaaggccttatggaaaactctgacctgcgtgttcattattgacgcccaagacgagtgcaaggaagttgatacttgggatgaggaaatttaaatcagcagctgatctggaatctggaagcactgccccttggatctcgccaaatatggaaagaattcttgtcactgagcaaatatagaattcagtgctagagttttacctcttgaattttctagaactttgttttgattagccacctagagtataagaattgctgcctatgggatttttcccagaagagtagataacataaagtaaccagcgataataattttcattatccaattatttcatgtgtctccataacacttaatacatcatgtttctctgcacagtaattcactatgtacagctagggtgaatagcaggaaaaaagagatcagatgataaagagaagggagacagatttgtgtgacttgtataagatacttcgcctctctaatcctttgtccttatctgtaagaaagcagcagtacccaggctgctgtgaggatcacatgagacattatgagagtttagcacaggacttggcacataacaagcagttattaggatgatgttagtttggattatgaattcaagatactacagctacattttttatactttcttaaacatcaatttaagtcaattttaattaacgttattttactaggagaaatgtctctaaaaacataagaattctatttgaagtctacaatgataattacattactctgatatcttaacttcctctttatgatttcaaataattaaaatttaagtttatgttttcaacaagtgcttattgaacctctactctttgccagtcactgttgaggacacagaagaaatggataagatatcactaaaaacagcttctgcgatatcagtgggtatacataaattattcacactcaacaacaaacacaagcaaagctgggagaatgtgctgacaggaaagaaaatgaagagtgggagagtggacagatgggaatcgatgtgaaattttataaaacatgtcttggccaagctcagtaggggaaatatgtggaaagtaagctagaccaaacagagaataaaagtataaataagaaaaaaaatccagaggtcacagtggaccactagccaaaatgggttcacagcaaacaaacaaaaaaatgtaatgaaatactaaaattaaagaagtacaaataaaaatgagattctgttcttatctgtcagaatggcaaagattcaaagagtaaaatattcagagttgttatgggtgtagtgtggaactggtctcatatgtggctagaaaaagggagaactggtataatccttccagagaataatctggtaattattttttaaattggcaaatatttaaatttggcaaagacttaaaaaatatatatacccattggctcaataattcctttctaggcaccaatactaataaaaagtattcaaaaaattaaatagatggtgtactgcaatataatgagtgaaacatcgcaagcagcatcactttatacactaggatattggttataaaatggtaatacatattttagatagaatataatgaaacaaaaattttgcttatcaaaaaatgttagtaacatgggaaaatgcttgtaaaacaatgctaactgagaagagcaggacaggtaggtagatacaaggccaaacagatacacacggtggagagacatatcccaattgttaggaatttgctgtggttggttaggatctgaacaatttatattgactttgtgatgacttttaaacgttttctctaccataagaattttttatgtttataatttatgctaaagaacaagatgtattttttgtaattcaggagtaaagaggagagtggggtattccagggtgctgttcctgccctaaccaggagcacgatgcagtcataggcctctgccctcctccagcagcctcggctcagaacaggacgaagccaaccctctctgaccagcaccacctcgggcgacccctggacgctccacctgcccctgtgtgtggtacctgccctgctacacctttaacaagcacccctgcaagctccctcctccttccttccctgtcctgtggctgcccagacccagatgtaccctgcctgggtgtgggaggccgcacatcagagcagtctatggctgtgggcttcacagctgaagctgggccgtgggaaatgttgagacgagtgagtgcagagcctgaaagacaatacggtagaaaaggttacatccgcgggggggcgtctgatggcatctgccatttattgaggatgggtgcgagacagggtagccattatgatcccattttacaggtgacgaaactgagatcagacaggctagctaccttgcccagggtcacaacaggaaggaagcaaatgcaagtgtgtctgcggccacgtaaggtgagagaagcgctatcaggggtggtctgacagaatccccaggccagggagcagttgtcctctatcctgtggggtcaaaggaggggacaagaaggctctccttgaggtagctccaaagaaaagaccccgccagagcacagtgtgctaccaaacgctggaacagcctggagactgtccctgtctcttctctgaggtttctcatttcagagaaactctcatccgtctggcttccccatggcccttactctgtgattctcttatgtatcagctgttaaaccaataaatccgccaaattgttgggatgcctataatggctttgggtctccactcccacagagggaatcttattctaaagttctaaatgtatcagtcatattttcctgaagacaacagaaatggttgtttcatttacttatttttatgtatgctttttcaagagttgttaacctgtgtttgtgtttaaataaagatctgttttgcaaaacaaaaactttatgagataatcacttataaacgtagataattaagaaatggttcaggctcagcacattgtctgagagcattgcagtcctgcactgtatttcatgggggaagaaaagcccacagatggagccattctcaatcctgctttccagggtcactgagtcagggtgcctggcatgcatgggtgcatgcacacacaggcagagggccagggagaactgtgctgtgtccacagagggcagcctggatcacagagctgaccaagaacggaagcagcaagttgttttaaagtagttgcctgtaaagccacttttcggcaaggacaaacactcagagcatgctctgaaatgacttatgcacagcagggcagcggcattttgcccctggccttccttccattctcccggaatccccctaaagtaacaaggactgacgcaattcgtatttcacttagccaacaggttgatgaaaaatcataaatctgtagctattaaactcattaatcacatccatcaaaattctgtgaggagttaactttcttcatataactcttagtcttaattaagtttccctcacatgtgatagcaaacgttcaagaagtgcaaatgtgcagacgtggcgtatataatgcaagctttatgtctttaaattaataaaattgagtcctatcaggtcgtgtttcaattaccatcaaaccttccaacctctgttaattcaaaaaaaagtaacttctttaggcaagtcatggaaatagcactagggtgccctcaggtctccaccaagccttgttagtaactttccatgtcctgtctgatttttaagatgctttcccctgatgctgctgccggctgctggctctctccacatccttcaatgtcagatctctgtgatgatggaaaatcccccacattccctttttacacattaagtatctttctaggatcagaacttgcaacctggggttcatgttctccttaaaaggtccggggagaggactgtatttctgttgtaattctatgtatttctttttaggcaccagaaagtattattctgagaaaggactgtaggcttcactagacttcccaaattgcagatggcattaaaaaaaaaggaatcaggaaagtctttgggaaattaggctaaaactcctaactgaagcacaatcgagttttcagtgcaacagcaggatccctgcagtctgtagcaaacactgagatgtttgtggggacagtggggccggtgaggttcagcacctctcaatattgtcagatgtcaccaatgcccaagggaagcaccaaaaccaatcagtgaattgtctgcaaaccatcagctttgttgcttccaagtctttactagaactcttaagctgatcttaaaattcacagacacttagagataaatgaacactctcacataagttcccaaaattcctttacttcttccaattgaaacattttgttcccaatttcaagttaccaagggaaaatgatggtaagaatcacaaagactggatacgaatatttagcttttcatagtgtctcatagggtcttacaaatgttaatgcaaaaaaataaaaactccactcaaatgcagaaaaccaacttaaaaaattcagagcatctgatacctaatcgactaattgatttatttactgaaacaacaaaaaaacagagtgcattgagactggaaattgcctctatggggggctgtttcctaattccagtggacagccatcattttccctatgctaacttgggctttgcgctaacgtaattgaaactgtagtcaacagactcaggacctcctttttccactctataaacaaggctgtaaaatcatctcattactttacccaggaaatctaacagaaacatgtcttaaaggaagtcacctataaagagggcctattttaacagaagattaaaaaaaaattcacctgtagtcattctaagggttcacttgggtacatacaataaacacataatgcaatgtaataaaatgttaaatcaagcatagtaccttagacaagtgtaaactattatttccaaaaaagtgttcagaaaatcacaaaatattcaaactttcaaaatagcttcatgtattcataaatgtatacttcaaattaaacagtataacacatttggatgttttgcaaaatgtacctaccttctaaaggatggtctgttatttcaatgtcctttttaatgcactgagttttttgggaaaaaaaaccacataagatcgtacccaagctattcaagatttacacagaatatttgatttaacatgcatatgaataaggatgaaaataagaacaaaaaaataacattttgggtcacaaaatcaagtaatttctattcatgtagctataagtagggcacattaactctcaattttataattcctgtctataggagccatatttcagcagattccaatccttgaagccaaagaaagaaaagtataaggtgaaagttcttggtacacagatttttaatatattattgaacacaccttgagaaataaaagctgaacttctcaaacacagtttctatggtacatatgagtcaaatcttctaatacaaacatttcaaattatgaaaataccaaaccaaagagtatttttgaaaatggcttggcccaattctgggcaaacttccattttcttatgcactttccaacaaactaaaagccttatgaaaacaccaccaaatgcttctcacctccgtgcagcaaaactaaagacatgcaacaaacacaattttcttttccctccactcagcatctgcttttgttgctgatttttcacatttctacaaatgtcacgaaggcatggtggcctttaaaacaactgaacggacccccattcaagactgcatgccccttgacttgtagtcaccattaaattggcttcatttccaggaatcaggccatatttaggattgtacctgtgcagatttacctccacattaatctctacatgctatctactaaaaacttaggcaaggaaatgcatcagaccaaacaccccacagcacagagaaccgaccggccattgctttccaatctccgcaaacctaaccattgctggaagaaatcttactcacagtgcacagacagtaggtattttattgaagataaacatatagtggaacaaaccaaattacccccatttgagttacgtgagcactcagttctcagcgtggatgtcccacaaatcaagtcaacatttgcgtcccattaccagcagccacttgccgagtatctcttcgcttccactgggactgcctggcatccctgatgctaaggagccactgaagagcctccaaatgtctgacattcacaaacgcatcttttgctttgacccgacccttcaacctctccgagtctgctgccttttctcagacacacatccaggcaccgttagggatagttagagaatctgaaaattcagaagcgctccgaaaagcctttccaaaagtaatccacagcactcaacagtgaatttagaaaccccaatttttttctgagtttgaagtttttaagccttgcggatggttggagtaggaaaaaggaaatttactaggcagtgcaaaggaaatcttgttgtcctctattgtggcagtgggggtgttgcccaaccctaacttatctgccttgataaaggaaaccaaagaaaagagtaacaagaacaagattttgtcaaattaaaaggaaccctttccttaccttaatagtgctggccataatgcgatcaagtttattgatcgttaataaatgttaataataattattgcttctctctgaccagaaagtagttttgatgaggttgtttagagcggatgagattgtgctaagtctgggaaatgaagtcagccaatggcaggaagaggtttctattggtcctggctgtccagcccaaagaaacaggatatttgggagtggagagataagagaccctgaaaacaatgttgtttttcttgatgatatgcagccaggagattttttttttttaattaaaaaaagaaaaggcatcaattgggatggggactgccacagcaggtgtgaccggtgtgccgccgtgtgacacactgcactgagaccaaggcaggatgcagatgtgatgggactccgcatggcttcacacgggctgcaagcaccttggagccaaggcgttgagggcaccccactgccctgggtgtcagcccttcgcagcccaattcttcgcagaattactaggacagaggacttgagctcctttctcctaaaaggaaactttgcaggtggagtttatttcatgttaatagatggccatgttcagtaacagccattgcctggctgatttttaacaacctatatttattcaacatttcatataagtgttccagaacagtttcattttctccttccaaatacctgcactttttatttgctctacaacaaagttgttgaaaacgcaaggactctaggcttacagtaaacacaaaaaataaagaggaaaaataaaccttcctaagtcttgttttcaagtatttattaaaacccaaataactgaagtgactacaaatgtcccggaatatcagtgagctggtctcactctgacagacatccatgttgcagacaacagatcctcatagaacttttggctacccagagatgccatgtgagggccccattacatgtctaaaatccaagctataagttcagggtcacaggtctgttttctcctcgaaggaagtacagcgaatgcaggcctgaacattccttagagggtttcaggactttaattactcattttcaggaaattgcttggaagaaacattttgctttgaatctagctacaggaacgcaggacccataaagaggtgtggtctcaataggcgaccccaagaacacaatagactaaatcctgagtcatctgacaattcctggttgcagagctggacgttcagtaaatggatttcactcagactttaggccggcatgtgtcagagttctgtccaccagcccaggtcattctggcttttattatatacctctgatttatcacctcatgttaggacaaaagaaggaggagaaggagaaagataaggggggaaagggagaggaaggagaggaggaggaggagggagggaagagggcgagaaaaaatggagaaggagaaaggaaggacagaagagagagagaaaggaaggaggatgggaggaaggagggaggaaggaaggagaaagggagggagggagggaaagaaagaaggaaaagaaaagaaagagagtatattgtaagaaaatcattctgtggaaatcagaacctaagttctcagcacctacattatgagggggtgttgatttccgctcttttcatctctgaacaatgaataagatggcaggctgattaaaattctgtttccccgaaaatttcaaagtcctgagctgttttatctgggcagcttccactagaattctggagtgcggaggagaaaagctctctcagcttccctgagtgtccttgctttttgttctctcctaagaagcatcaatgtaaaatgttaactgtggcctccacaacacatggcacctgattatgcctttaccaaacaccagctttaaataagatgaacgctttgctaatgaaatagccacggaagaaaatcctgtgtggtcccgcctcacccacgcctcgtggttgctaatccagccctcagttgttccctgcagcaggaaagatcagcatttctactgggacctaatgcttcagtgatgatttggccttaactccctggttcttgcctaatgcaaatcaaactgtgaagagtgggatttcttacctctctattttgaaataatttccaacttacagaaaagccacaagataatacaccaaactcctaataccctttgcctggttaactctgattgtctactggtgccaatgtacatcattttctctgctttctctcacacatgctctctctctctcaatctctgtctctctctcccatatttatttatgtataacatacatgcatgcatatatccatcattttctaactaataaaaatattgttttataagagacaaatttatttattggatactaaaaaagagaaaaacagatgctattatttgatcaatattcgatccataagttttactgcgtctaattttggaaatgcatacaaacataaaaagtgatctaataaaaagttaatttggggatactgagtggtaaattctgttccaaaattttacaaaggaaactcctcctcatttctaatgacaaaatgtttgattgattcctgttgtcttcaaagagaataattcttgatgtttcaaatggcatcatagcatccaagcctggtaatctctgactatttaatgtaaagtgttttaaaaaaatctttggctcttgataggacaaggcacatcttttttttttttttttttttttttgggacggaatcttgctgtcgcccaggctggagtgcagtggcgcgatctcggctcactgcaagctccgcctcccagcttcacgccattctcctgcctcagcctcccgagtagctgggactgcaggcgcccgccaccacacctggctaattttttttgtatttttagtagagacggggtttcaccatattagccaggatggtctcgatctcctgacttcatgatccacccgcctcagcctcccaaagtgctgggattaaagacgtgaaccaccacgcccggccaaggcacatctattaactagaatatagcagtgcagaaaccgtttcccaaatattatcctatggggaaattatctgaagatatagatatcactctagctttcctcacttgtaccccaagtctatgttattaaatggcctcatccctacaccacccagcagcctaagaaccaggctgcctttcccacctgatacctcctctccctagggaaatatgccctccaagccaccacgcggaccaagttagggggcaatctggcacacggcccctacctgaggcccgtcctgccatgagcctatcagggcagggtcctttttcactctccttgagatgcagtaatcaccacactagaccagcacagcccatacagtagctgtggacagcagaacctatgaataaagcacacatttcccttgcatgcttctctgccacaaacccatcccctgtgaatctgccaaaaccttccactagtctcctcacattttactccaaagaaagaaacaaaataatataacataaatataccataaattcactgtcacaataaaagaaacactagtatttatttatcctaaaatcatttcttcccattttctaaagatcgaacaagttctcattcttgttcccttactaacttctctgtatggaatatggggaggaaggttaggagctaagaacactctgaatgacagccacatggttctcaatgtaatacatgcgcagagcaaagagaggagatccgtctgaacctccacatctgtggggacacaacagaagattcactcatgactcattcacgtctttatccctgccctatacatccctacaatggaacgcccttcctcctcaaaaacattgcaggaaaatgatgtcgtagatgaacacttagcaatatggaaaactgctctgatattttacctggttagttaaaaaatcacagtatataggagaattatatccatagactcattttgttaaaaataaaaaggcagttggggatggccgtgcattctgttccaaagcatctgtgaacctgaggaatagacaccatgagcgaagctaaccttcccgagttgaaaaatgaaatgcaatggtggcagacatgtccaaggaatattatggggactcgatccctttatgaatcttgtcatagatgaatgtgtggagatgtcaactagttggcagcagaacagtattggaacggtggtaatacaaggaaatagtatcatcatattagaaactttggaatgagtataaataatggctgttcaacagaaaaacccatgtcccctctccaaagggcctgtttcactatatgtaaaaattaggtcatgtatgttttcatattagactttttgttaaataaccttttttttttttttttttgagtctcactctgtcgcccaggctggagtgcagtggcgtgatctcagctcactgcaagctccgcctcctgggctcatgccattctcctgcctcagcctcctgagtagctgggactacaggtgcccgccaccaccctggctaattttttgtatttttagtagagacaggttttcaccatgttggccaggatggtctcgatctcttgaccttgtgatccactcgcctcagcctcccaaagtgctgggattacaggcgtgagccaccacgcccggccaataaccttttgtaatagtcaaaaaataaaaaataaataaaaaggcaaagtaaaaatattgacagctatatcttataataccaatggcagagaagctttttgttttttcccctcttcttctttggttcacttatattttcaaaacataaatttgtaataaacataaattatatcctaatataaaaatatgtaagtaacatgcaatgttgttcatttttgtaaatatctgaaaaatacaggcatgttctgtaaaaagtgcagcccacaatacttgtaggtgtcaaaccttttagcatgcccaaatgcctgttcttttttaaatgtctacagcaagcatagagctctttttttttttcattttattaagaaaacccagaaacgctcaagagtttcgtggaggccatctatgcggcattaatccattcaggtgatattaatggccttttcctgccaggaactccagtgggcactcaggaagccaggattacagggctctatccagtcaccgcatgtctcggcattcgggaagcctatctcagtctcctcaaattctgcacacataaaacttcagagcctgggagcgacccatgaaacgcaggtttttaaggacaaaacaataggacaaaagtgctgtatattgtccttaagatgacacatgaatttaaaatgcatagtgtttggattattcatgagagccccgcaagaacgatgtcccaggggtttttgccaggaacatgcctgagattgtagataagaatcaagcatctggggctgccgcacaatggaaaactccagcactccatggaacttttccatctgcagcagtcggaggatttgcctgagaacatacgcggcatgaagacactctcagccctcaagggcacccagtcagcgctgtttaaggacggtttttctgttcacagcatacttcatgattacagcttcactccattggatacaactatgtgagtatgtgtgtatgagtgtgtgagtgtgtgtatgagggtgtgtgtgtgggggggtaggggagtgccatatcccccagcagcacattaagaaataatccaattacaatttaaataaccattgtttcaacactttctctaagtggtgaatgtattcttcagtctcttggttgatctgaactaatagaaaccaaggaaactgttatcacataccaaatcctcaacttctcaacaccaagttgcaatttccttaatactgaagcacacgtcagttcagttctataagctcccatggagcaatgatttcaataaacacaatttcataagcatcccacacgttctcaagtttaggccaattttgctcttactcaactccatatgactttaaaaatgcaggaatattaaaaccattatcaaggactccaaataggtcaatgtattatctgtggttttaagaaagaaacctaagaggagagtaattattttgtcaccattatttagcttaaaataacttttaaatgtattgttccaattattaggcttctccatataatttggaaaccattaaatgagtttcaacttctttgtccgtataactgggtatatctgagcatagatgctacagacatcacgttgccattggtgcccataaggcttcgtatgcccacagggcatataattaagattcacaaaagcatctgactggcatcccactctacccccgactcagatccaaagtatcctttcccaggtactgtcccctgtcaccatccttggccaaattgagaatttatcccaggttgttgaaattaattttgattttgattctagtcagagttttaaatgattttttaagaagtgtgtcaatctcacctataagatactaaacagcatcacttatttttgtcttaatctgtcactattttatgaattatttttaaagaaaatacagattacttcttaaagaaagatcataagtggcactataatagcattcaattgatagaaattgatgtagaagcctgcattaataatttttcctgctgctttctaaagttggcttttagttttcggttgaggtgggctttaattcagcatcacctcatttgatgatttatttactaatttatttccatcacaaatggaatcagaaatgaagcgaaggcaaaaaatctttgccacaaattcatttatatttgcatgagtatcaccaggctacctgcggatgcaatgaagccctatacccgtgcctgaagtcaggagcacaggacactgggagtctgtctcagcgcagtaactgctacatggtacgctccacatggtatcctctccacctgagccctcctcatccctcgccccctctccacacctcaccctctccacactgtattatctcccactgcaagcaacgcagaggacacagaggtgcagctgaagtgaaggcaggccagttcttttccaattcactcttatgaaaatgtgttaaatcccgttaaatgcaccgacctgaactgaaatgatgatatcagtaaatttgttgttgtcatctgatgcccacacagatctcagcacatgttttgggaaaggctgcagtgttcaaggagtactagaaatgttctttctgagtggactggccatgataagccaaagaatattatagccgatagggataaatcatggttttcccactgcgcggttgcctggtggagattattccagcctttatttacagctacaaaaataatcctgcctcaaggattttaggaagcaaccacctcctgcctaaagaactacactgcattgttgacttgccagctagaaaccagacatgagtcgtgcagggaagttccctttgaacggcttgaattgttgtcactagagggtgctaaatgcccctcaaaaaggcctttagagagaatactagtgtgcctaattcttgatttaaattccttgaattgacattattttacaaagtggtctcattttttacttgttaaaattaagatctaacatttataatgcagaaatggtgtttttttttgaaaaatttggattgttcattattatagaacataaagaaatacacgttttaggagcaaacatgaattacacagatctgaatataagattaaaggcataaatctgggggggtgagatttgtccatggaaattgtataattgttttatgccactgttaatgattttaaagcctgaaaaatttaccactttacaataattttagattgttcaatatgttcccaaatgtgagttgcatcaaattcggtaaatgtagagtatgtttgttttctctgtacacaatactgacgtcagtgctagtgcctgcctaaactcagacaccagtagatccttttccagaactaagtgttataggaggaatatggattatactgtaatatatcagatgtgaaaaaagcctcacggtcccttcctttctcaaaaaaaacgtgtagtattttggaatatgcatggagtatagcacttctaaaaatggtactttatgtatatatgaagtaaaataggccttaaaacttaatatacagatttccttgaaaataatcttattatacatttacactgactttttggtcatccaaacattatgcacttaagcaaaaagaaatataaccaattttgcaactttcctcttcctgcctttgcttctacttaaaaatatctgcagtatttccttttctcgccgcttccactttggttcatataccaaggaatcgtgaggtcaatgggtgacagttgtttgtctgtgttcacggctgtcgggcggggctgggtgtgggtaaggctctgaccgacatctgaagaggcttcacccactgcggtttaggatacattttcctctcgctctgccagtagaacagggaggctagttttcaatgtgttctacagaaggataattaaggcagtgtgtcacctgctcgtctgctatttttaaaaggaaacaaacataacctttgcatgtgagaggcattgcaaactagatgggaggaggcccggaccctgtaacagtcgtacattccggtcccagcttcgctggggtgcaactgcagataaaagacgctggctcgacaaaaagcgcccctgggctctgcattgccagcatgcacaatacgaattgctaatgatgagctggcttaggtaggaactgaggaccctgagtgcagggctaacctctgcttcacaggaggggtccactggcgcgcgctggaggcggggagccttcgtgatatttctccgaagggaagagtccatgcagcatcctgataacagggaccttggcttcatccccaactgctcggtgaccccgatgcgtcatttaattcatttgtgccaatattcctttttcaatcaaccagtaactttgcaggtttgttcaaagaagaaattaaaatgcattggagatggaaggcagccatcttcccggagccccagtgctgacactgggaggggaaccccaggattccctcatgactgtgtcagtgatggccctcaacaagcacttactgaatgagtgaatgaatgaatgaatgaatgaatgaagccggccacagagcccaggagtatcaggggagagcaatactggctgtgtcagtggctagtccaggagagcccttcaagagcccagagttcgacttgaacttgggactcccctgggatgggtgaggttctctcaacagcagttgacaggagggaactgggacaggcccagccagtttcattcagtccagccagctgtggctcctctttaggaatgtggccaggcccagctgtggccaaagcaccagccagtccctcagttctgaacagaacgtgcccagcatcagtgccttcatttgtttttaaactgcctgctgaccatccacaaagttaagatgacagctgggacttaagttgtgaggaaccagtggctcccccatcactctctctcacacacacgcacatgcacacacacagagacacacagacacacacacatgcacacacacagagacacacaaacacacatgcacacaaagacagacacatataaacacacatatacacacatgcacacacatatatacacacagacacacaggcaaacacagacacacaatggatggtatcgatatctatgaacagatgagagagagagacagagcaggaggtcatctgctccccacccctcttctccccactgtcaccacctctctcccaagtctagctgcaggccctgtgagctgtggaagtggcttttttaagctgtcttcttagattgagtcattgggcagtgaggaaggtaaattttctctaagaagcctcccaaatctgtatcttatgggatttccgtctcaataattgagctaatagtacctgtaagcaagtggatagtcaataaaaaaaaaataccggctgtaagaacgaatgaatgaatgagtggatgagtggatgagtatacatcctctattttgctggcatcatgattattttacagcagatttatctggatttcaatataaaataagagctcccatttgtatacaacttagtccttgtaattttccaaagtaactctgattaaaattatttccagccaaactatttaggcaactgggttggtttcacacgtacttatcagaaaccattagaatggtatattgattgcatttctagacatttgccataccaccatggcaactgtatttcccaagatggcccagtaggatgtcccatcatgcataaccttctataaagtgacattgactttgcttccatcagaaagtgaggtccacgttcccactccttgaatctgagttgggctgtgactacagcagaagttcagctatgtggcttccaaggctaccttggaaaggtgatagagcttccacctgattttcttgggaacagccactcttaaacctcagccaccatacggggagaaagcccaagccatgtgacgaggccatttgtaggtgttccagtcatcagtcccagcccacagccagcattaacccccagaggtataaatgaagaaaccaagatcactccagccccaaccggcacttgactgcaaacctataagagactccaagcaaataatatctatctcagcccaatcaagccctggaaccatgagagattctaaataataaagtgatcattgtgattttaagccactgagtcctgcagtgagttgttatatagcaaccgggcatcggcataccatcagaagattccttaagaagaaacttttgcaacgttgctacagcagaaaatattccttctgtatgatcattcatccattcatcaatcttgattggcattgcctatgtgctaagcattgtcggtcactggaggtgcagaaaagaagtgaagcagtattcagccaaacaaacaacttgcatattggatagagagaaaaatatgccaaaattacaacagtattttgacccaacagaaaggacataagaagggaacatcaacagttccttcctattcttttccaccctttttctttctaggctcattaaatgtagaggtgcctcagggtcactttgccccatgagagtagataccctcctctcccatccctaactttggtcttcactctatgcctgataccagcagctccccaggctcctccatgctgttggcaccccattcccattctctggaaacatctcagcccatcaacctcagattactttcccaaggagatgtgagaaaacttcaattttcccctttgtgacttgcagagaaataggggtggtaaatgagaagcagagggagagggtggggattcattaccttgagttactaaagagaaaagctctagtgtttagaaggtgctgttattattttctctgaaacattagctcctagaaatcagaggctctgtccctagcatggtctctaaggcttccaggacgccccaggggcttccctcagtcaattttgactctaatgagagccatctggaaggctgcaatggtgggcctggctgatcactggaggggccttcgctgtgggcacagggacgtgcacaggttcacagagtgtgtctccgtttctgggaaccatggtcctgtgtgctccttccccaaagaaagcaggagaaagaaaaaccacagtcctgagtgggattctccccaaacatctaaaaagcttctttaaagaagtcaagttatcataattaaactcacatatggaatgcctatagacaacgtgttgctcttccaatcccagggagctaggacacccaaaactcacctcccagacggagctaggatttgagatactggattccacattacttaaagctgttcgagcttttcatcaggaatggaaagcattaatgcgtctcacacgtcactctctgtttcatggaattcttacactggggagctctttttattttactatttttctttaacagccagaacactgagaagtttgcaaagaaatttttcagctgcctttagtgacccttaactcaagaggttttgcctaatctgtaaattggagttgaaaatatttcagtacttttggagtggggagctttttgtctttaaaagagtggaacgacactaacaatagggctatacataccttgtgcttctttgtcagttactgcaaaccaaaaccagatgtgaagtatcagcggctacctcgtagtgacccatggaagttgaggctaatccatatcattcttaataactcaaaactgccaccttttaaccacctaatttttttctcacttacaaatgcaaaaaaaggaattgacagtacacattgaaatcgattttcccctgaccacttacagattttctcctataagagccaggaataaaagctcactccattatatcaagcagccatcatctgagtatgctttagtttaggtgatcatcacctttaacaaaccaagatctggaaggaagatttctgatctttaacaaaccaagatttgaaaactagatattcctgtcatgaccttttcccaacattcagtatgtaagggattcactggattattagactgcttgtaaatgtaagaaaacatagaaggtttagtgtgaaggagttagcaacctaacaaatgtttccccctgaattttcaataaccttcctgaatttaaaggtaatgaatataaatgaagaacaaaatcaatagatataggaatgattcacaacctcccaaatgaataaatcaatcattccaccctacatttgaacattcaatcaatattttgtctatttactaaatctaagaggaactactttaacataaaactaaatatgaaattatttccagcattgaatattgtgttttgccttagagcaggcacaaagtggaatgcctatgggtacaaagctaggcattgattgatgtttaatacctacaaatacagcaattacactgtcatgctacacgagacttcctattcctacactgaaattagactgcacatatgtagggataaaagataagacacaatcatatcatatttcctcaaatctaagactttgggtggtaagatgtaaagcacatcatgatttaaagtatcactaggaaagaaaaaacaattctgccaatgaaaattcaccgtaatactttctaatcaatcaattttaagatacatcccaatttttaagcaagaataaatgtgttaaaattaacacaaattggtacacttgtgatacaacagaagcactaaaatgtcacagcaatagaccacagggtttctcaaccttggcagcatcaacattttgggttggttaattatctgttgtgggggctgccctgtgcatggcaggatgtttgctagcattcctggcctctacccactagatgccagtaacacctcgcagactccaattatgacaaccaaaactgtctttagacatggccaactgtccctaaaggtgcaaccaaaaactgtcccagttgagaaccactggaacagagcaattcggttttatcagccttgtaatataattgtgtgtgtgcactgtgtgcatgacagactgtcagcctaatggaaggtatattgtcagatgggatagattgacctgaaaaaatcacataaaccaacagctggtacatatacaagagtgtgtcctgcccatcctaacccacacaatgcaaaagaacctggatgaccacgagtcaccatcacaggagtttactatccataagtgtaaaccatccaagaaaagtgaaaacagattaaagaaaataaaaataaataaaccaccacacaatatttgggcctagccagataacaacaatgaaaaaatgtaatattttgaagtattggcaagaatgtggaggaaaaagcattgacattcgtgtataatgggaataaaataatttatcctttgtctccgcaattgatattctagaaatctattttttagaaatactcacaatagacagttataagtacaaaggatgtctgctattacactgctcagtaacagtaaaatatgaaaatacactgtacgtctttcaatcagatattgaataattatactacacagtattaagaatgagatagatattaatgtactgcatagaaaatattcaaagtataataagttttagaaaattatcacatatgtatattagcatatgcagagaaaacatcttaaaatacaaatttcagttttgaggtttggatcatggagtaactgcccccttttcaagtcaaacagttgagaaaatttaggataaaacaagtgtgtgctacctttgtaatcagataaagtattttaaaataattcacattataatatagaaatactgaaatgccaagaaaatttaaatatattaattaaaacctacgggccaggcgcagtggctcacgcctgtaatcccagcactttgggaggccgaggcaggcggatcatgaggtcaggagattgagaccaccctgggcaacatggtgaaaccctgtctctactaaaaatacaaaaattagctgggcatggtggcgtgtgcctgtaatcccagctactcaggaggctgaggcaggagaatcgcttgaaccagggagtcggagggtgccgtgagccaagatcatgccactgcactcgagcctgacaacagagtaagactccgtctcaaaaaaaaaaataataataataggctaccaattagactttatagaatacataaatatattaatatagctacaaagaggttgaagcttattcattgagacaagagtatttattgagcatcgactttattaaatacactgttagtaagataacaagtgaaacttgttaaaaaaaaagaaactaggacaaaagaaatttgagttgagttccccaaaaacagggaatattcagattgtaggggaaattgggtaaaggatttgtttcagcatgaaaggagcaaggagcaaagaaactaaatgggaggttatgctgagaagtatatcagtatgaggaaatatcttgacatctacagacaaatatttgttgccaattcattttgggcattgaggattcacaagaataattaaaaacacgtaatataaaatccttctgattagagcacattttatggcactgcataaagagatggctgtgggagtcatttatattttaatactaacttgaacaaggcttggttctgcaaataaaacagaagagtaaatatgaagtggagcacataataatgttactgtttctgtgggtgagcttccataggaaagaggcaaaggcatcaatctcaaaaagttagaaaaacccaaagaaagaagaagaaaaataacaaatgagaacaaaattgagaaaattgtaaataatatggtagagaagataaacaaaaccaaatctggttctctgaaaagattagttatgtgtaagtcactggtgattacagagagaaaagagggaaggttaaaataaccaaagtcaacaataaaaagggggctattactacagatgctgtagacattggaaggataatagaatattatgatcaatttcctatcaataaatgtgaaaaattagttgaaatacataattggaaaatataatttaccaaaactgtcaaaagaaaaaacacaaaacctgaactcctataattattaaagacattgattgaaaaatctcagacctcttaaaggacaactccaaaaataaaaaaataaaaaaaagaaagaaagttccaggccagacggatttatcagcaaattctaacatgcatttaaaaaaaaaaggatgccactcttacataagcttttcagataaaagaaaagaaagcttgataccaaaatgtagctagaaaattatttaaaaaggaaaattatgggtcaatttcatacataaacatagatgcaaaatcctaaataaaattctagaaaacaaaacccaacagtatatacgacaataatatatattgtgaacaaactggatttattttaagaatgaaagcttgtttcaatcaaataatcaaatttacattgtaaagaaaatttatataactttaaacaaaagaagaaaagcacttaataacattcaacattcatattaaaaattcttagtaaattagaaataaagaggaagtttataaatcctacaaattgataaaaggaatctaccgaaacctacagtaaaccacacattttcatgtcaaaactttaaaatttaatcatttgaagttgggggaaaagacaaagaagccccacatattaccgcatttgtctgaaattgaattggcagtcttagttagtaaagaaggcaaggaaatgaaatgcaatgttaaaggattgggaaaaagtaaataaaactttatttacagatgacatcatttttttacacagaatttccaagagaatttggaaataagtcattagaattaataaatgagttttaaaagtttgctagatacaaggtcaatatagaattttagttttatatatcagcataaacatcaatagaaatcaaaatttttaagtgatactgttttcattagcattaaaaataccttacaatatggacataaatctaacataatacgtgcagaacctctacaccaaaaactacaaaatattattaaaagaagaccaaaataaatggatagatatattcatggattgaaaaacttaataatcaaaggtagaattttcttcaaattgatcaatagattcaatgcagatgcattcaatatttcaacaaagtttttgtgaaacttgagtgattctaaaatatgtatggaaatgcagagtcaaaaacagacaagatgctcttaaagaagagtgagaaatacaaaagattatcagagactattacaaactggaaaacctagaggaaatggatacatttctgaacacatacaacctgccaagattgaatcagaaagaaactgaaaacttaaacagaccaataacaagtaataagattggataggaaaaaaaatctcccaacaaagaaaagtcaaggaccagatggtttcactactaattctaccaaacttagaaagaagaactaataccaatcctcaccaagccatttcaaaaaattaaagaggagagaattcttcctaattcattctatgaggccaacattaccctcataacaaaatcagacaagaacacaacaaaaaagaaaactacaggctgatattcctgatgaacatcacttcagttcagcatggatacaggccaatatttctggtgaatataagttttctagtattttgttcagcaaaagctatcaacaaaatattagtagcctgaaaccaacagcacatcaaaaagataatgcaccatggtcaagtgggatgtatcccagagatgcaaggatggttcaacatacacaaatcaataaatatgatacatcacatcaatagaaaaaaacaaaaaccatatgatcatatcaataaatgcagaaaaggcatctgataaaacttaacattgtttcatagtaaaagctctcaacaaactaggtacagaagaaacatacctcaatatattaaagtccatacatgattaacccacagctaacattatactgaacggggaaaggcggaaagtctctcctctaagaactggaacaagacaaggattctcatttttatcacttctattcaatataggactggaagtcttagccagagcaatcaggcaagagaaagcaataaaggtcatccaaactggaaaagaagtcaaattgtccctctttggagatgacatgatcttacatctagaaaaacctacagactccaccaaaaaactcttaggtttaattaaaaaattcagtaaagttgcaggatacaaaaaaatcagtagcatttatatacccaataatgcactggctgagaaagaaatcaagaagaaaatcccatttacaataggtataaggaaaaaatatctaggaaaaaaattaaccaaggaagcgaaaaatctctacaaaaaaactacaaaacactaatgaaagaaatggaaaaggacacaaacaaatgaaaagacactgcatggtcatggatcagaagaactaatatcattaaaatgaccacaccacccaaataaatctacagattcaatgcaatccctgttaaaatattaacgtcatttttcacaagaatagaaaaaaacaatcctaaaatttatatgaaagcaaaaaggagcctgaatagctaaaggaaccctgaacaaaaacaacaaaactgggagcatcacataacctgacttcaaaatatattacaaggctctagtaaccaaaagagcatgatactagtataaaaacagacgcatagaccaatggaacagaattgataacccagaaataaatccacatattcacagccaaccgactttcaacaaaggcatcagtaacatacattgggaaaaagacaccctcttcaataaatggtgctggaataattggatatccatatgcgaaagaataaaactggacctctatctcttgccatatataaaaatcaactcaaggtagatgaaagacttaaacttaagaccccaaattataaaactattaaaagaaaatagagaaaacatttcaggacattgatctaagcaaagatttgatggctaagacctcaaaagcacaggcaagagaaaacagacaaatgagactatattaaactaaaacacttctgcacagcaaaggaaagaaaacaaccagcagagtgaagagacaacctgttgaatgggataaaatatttgtaaactgttcatctagtaagagaaaatccagaatatacacaaaactcaaacaactcaacaattaaaaagaaaacttttacaaagtgggcaaagaacgtcaatagacatttctcaaaagaagacacaggaatggccatcaagcatatgaaaaaaaatactcaatatcactaatcatcagggaaatgcaaatcaaaaccacaatgagatatcatcataccttagttagaatggcaattattaaaaagacaaaaaataacagatgctggccagaatgcagagaaaagggaactcttctacactgtgagtgggaatgtaaattagtacagccactatagaaaacagtagagatttctcaaaaaactaaaaataagactcaatataatccagatatctcactactgggtatttatctaatgaaaaagaaatcagtatatcaaaaagatacttgcacccacatgtttaccgcagcactatttaccatagcaaagacatgaaatcaacctaaatgtccatccacagatgaaatggtaaacaaaatgtggtacatatacacaatggaatactatttggccataaaaataaggaaatcatgtcacttgcagcaacatggatggaaccggaggtcattatgtcaagtaaaataagccaagcacaaaggacaaataccacatgttctcactcctatgtgggagctaaaaatgttaatgtcatggagatagagagtggaatgatggttaccagaggctgagcagagagtgggagtggagaggaagagagtttggataatgggtacaaacatacagttagatagaaggaataagttctgatgttgtatagcagagtagctgactatacttaacaaaaatgtattgtatagttcaaatcagctagaaaagaggacttgcaatgttcctgacacatagaaatgagaaatacccaaggtgacagacaccccaaaaccctgacttgatcattacacattctatgcatgtaacaaactatcacatgtaccccataactatgtgtgtgtgtgtatctatctatctatctatctatctatctatctatctatctatctatctatctatttatagtatccatttttaaaaggcaaatcttaaaaaaaagagtgaggtaggacaacctgctctactaaacatttttataaaggcacagcaattaggtcagaatagtgttcatgcaggtagaaacaaatcagacaatggaaaagaaaggaaagttcagaaacagattcacacatatatggacacacttgatttttgacgaaggtggcagttgatttttttttacaaaggggcagagtagttaaaaaagggagaaactgttggtaaatgatgctggaaaatgagaaatccacatgagaaacagaaacttgagaagtaactcataacatcacaaaaattgatgtcagataaactataaatctaaatatgacaagcaaaaactatgaagtttctggaacataatatagaaaactatattcctgacttgggaagggaaagattttaaaaacaaggcacagaaacactaagagtaaaggaaagactaataaattgaactgcattaaaataagaaaaaaattaggaacttaaattttcatcaaaagacactattaagagaatcaaaaggcaatgcatggagtggaagatgatatctttaacacatctaatctactattcatatccagaatatgtaaagaacccccatcaatcaataagaatacacacaagtcagaatacacacaaggaaaaacagggaagaaactgcacaggcagtcataaaagaggatatccaactgctcattaaaaggtcttctacttcattagtaaagcaggaagtacaaattaaaacctgaatgaaataacaccacagatacatcagaatgtctaaaacaaagactaacaatgttggtgaagatgtggagcaataagaactctcacacacagctggagtttaaaaaacatccttatttatccatcagggctgtaataagaggcatatagcatattcaaataggtaagtgaacaaaatttaatgaaagaatttacaacggtaaaggtagaatttagtaaaaaccaaagggtgaggaagtcccccaggctagcaagaacaggaagccattactaccctcaggcctacaagggcaagggaggtagcagtcacgcagcaccggtagctgtgaacacaggagaggataaacaataggagctgtggccttccatggagggaaaaagtcactgccaacccatgaccaaagagagaaagctggagaaaaaaactccccaagctctctcctcctactctcaggcttccttgtggtgactctcatttgcttaacccaacagaagatagaggacaaaggagcccatttgatgtagtcgacagaagtcaaactcccaggacaagaggagcagagaaggatggagaatgaattagagaagtaaacaaagaaagtcggcacatctactgtcatcaaagactgtgtaattccactatttaatacatgtacaatagagatgtgtgtatatgtgcaccagaagtcacctacaagaatgtccactgcagtattattctctcagttaaatgctatatctggctgcacaactagattaggactgagaccctaaccacacatgtagaagcagggagaaagatgcagttgagaagccctttgccatctgatatgcttccaaacaagggaaactcagcttggacactgaaagcattttgtataaaatactgtttgtatgatatccccatgtcaccacacacacacacatacagacacacacacatacacacacacacaacaaaaacaaaaaaaacttccagggttacttttctcctcagttagcaggtcaaaacttttcacgtgtgaaatacttttgcaaggaggcagatgaaacgggggagaagggataaccttgccttgcagtcatctatcaattcactgcaaggaaggaacacagagcttagatatgaagcatcaggagttcttcccaagacccttcttgtcccttgggaagagccaggagctggaggggatggccttcactgagaagtggcatcaaattagaacctgcacaacaaataggaaccagctacttaaagatccagagaagtagccctctagactgaaggatcagctcctcaaatatcctttttgattttgaactcacaagttcaggggcatccgaggaacagacacaagccagggctgaacaatctcatctgtgtccatgaggtgggcaagagccagatcctactgaggagtttgaacttaatcccaaacatggcgggaagccattggggccaaagatgaattagggattgtctgatctccttgacacgttctgaaggttttgtgtacagaaaaggtttgtcaacatgcacaaaggaaagctgggataaccaagctaagacgctaccgcatcattctaggggacgggtgactcattccaggagtttctgcaggaagacctatcaggactggtgattgactggaggcagagagcacgaaaaaagaacaatcagagatgatctgtggtttgtggttgttgtgtaatgttaaggcttaacaactgcgaaaatagtgtttttactttacagagaagaagacttgaagaatacaagattggggagagcagatcgggatttgtactttatatcagacgtgctcatagatatacatgttgagatatcagttgggagctggatatatcaggattcgagactgggaatcaccagtttatagatggtttttaagccatgtgattggatctcatttcttagtggggagaagtgagataacaaataaaagccaagattaaagctgaaccttcagcctgcccatcacttagaagcccagcagggacagaagagccagccgacagcacagagtcgaggaggaggatttccgggcttcagtgagtgtgcatcagagattcatggacacaacttaaagtaagaccagccacacagttcccttcattttctcaagcaacattcagcatctcaaagtgcggctactacacacggagccaagccctggtccagttatcacaaaaccttactagatatgtcgattattagctgcattttatagctaaaggtaggcaggcacagagaagttacgtctcttgcccacagtcacagcaagcaaacagacctcagaccaaagtctttctaactccttatttcacatctaaaacactatgtgacgccacctccaaaaaatgtgggggttactctaggacaaaagaagctcatgaaagcaaagagagaagcatagagcttaaatttagaacaatattcagggtgattgggaaaaatagcctccatacaaatataatcggttcatcaccaggtgaataaaatgagagaggaacctggtacaagtgaagttcattgaatttgcttgcaaaaaaacataattcaagtgtggaagtttggaaactaaaatagtaatcagctaaagaaattttcaggccaacttagacacaatggtgacaaagctcccctgaggagacaggaactatactacttgcaactctaactgaatggacttaacttagcaattaagatcaccgtaagtttgatcagataagtattaaagggtgtcttgggtacatttgcagattcagacactcttagttgtgaaattcttcaccaaaaatttgcaacttatggcttgcacattaaaaacatgatatgaatgaaattcagatatctcttggtaaattttataattattcctcccatcagctaaagttctcagtatgaagggttataactgatgtcatatacaataactacaagctgtatcatacaaaaattgagaattttctattatagaaagagttgctttaatctaaacctaaagtagcatcaataatttttcgtaagtggtccccttcctatgagtaagcccccaggaaaaataaattgcttttaagaaatgctgtaagtaagctgtttcatatataagttttgacaagatctggctacttaaattacaagatataaaatgagatttgtactttttctcaaatgtaaaaaaaaagatttacttctgaaataatggtctttataaaatatgcatttttgttcctttttcttatcatatctataaatttactaataaaagattctatcttgatttactaacatttgaaaagattgattatattggtattgcaagaagaggataccataaattaaaaatccatatattaaccatattcttttatttgcaatatgacaaatgattgtgtaaagttataatcaataaaagctatttgaaagtcataaaatggatattgccataactgctttcctagcaaggttaaaacactttaactatttttaatcaacttacagtgtagtagatcaagcatatctaaatattttattttaatcaagcaaatatatttctgctgttcctatgacagtatgaaagtttggttcaaaatatttccaaggtatttaacacagttcagtagaggtcctgtctcataaatcaatttcagattagataaaaggaaaaagcaaattcttgtttacttcagaatttttcaagccagttccaaagacagagttgttactctcatgtgaattttcagtagaaagctgaacaacgacgttgctctgacaatctttttaaataccatatgatggagacagaataacaaaaacaaagtaggtataagctgtacgaaattatttctcttggacataaaatatgtttggggaagaaatgcattgttccatatggactagggtagttacttctcaaagtgggagcaactcagactctgaaaaatggtttctcaaaggaggcattgtgtctgggtgaggccagttttctagtcaaaatcattttattaaatgccattggattgaatgcttccaggtttgctctctgaaatatgccctatcattcttaaaaaacacacttaggtagcaaaaagggcacactaaaaataacgtgggttaatgtttctatcctgcctgtgttttctaagtagcccctgcctgagctttcgacttttttaaatgaaccatcaaatagttggttgtctatcacaaataagccatctattttgttattcctgtaactttttgtagaatccagaaagtaacattcttgctgatatatcttatataacaccaagtccattttccaaatgaggattccaatgagtattcatcaccaacatctccccgaaaaatatttagaaaaaacagactcaatcctttatccaaagtcagtgagtaagaggcgggggccagggttggacaaaaatctctttggccaggaagccggtggtcaccctgatctacttctctaagctcccacccctgatgaatgttcaatatctgagtttcaccccactcattattgtaattctccgtaaaaccccagttacccacacggaattctcatctacatctagcccaatttgctactggatttcaatgttatttcatatgaaaacaatcactaacagaaagaacctggatctggtttcgaaaacataatttgaaaggaattcattctgaaggctgcaaaagcccagtgatggcccatcggtaccctgaatgggcttctcaggtgcctccactctcctccgtatgtctccatccatctcagaatacatgtctggctcttcctgctcataaacagaaacagagagttccgggatccaaaggcaagactgcgatttaagagacactttgtttttgtaggtgttcaaggatttggaatcaaagcagcagaattattaaaattaatccaattttcttgcatttattttgttagttcatacctctaaaagatatattttggaaggcacccttcaacccacccatttacaaatcaaagctttctttggaatccctgagaccaaacccaagctagacagtgacacactgccagctccagagccctgcccacctggaaggggtatggaatgcactatttgacttgagctcacatttaattacagtgtcaaaaatcaaacttaaattgctttaatcagctgccaacactatgagcctttctggcttgaatttctataaacaaagaataaattcaaatctgtcacaaagtggcagcaacttgttgaccactggactaggaatcgttatgcaaccatggctcactgtggaaaaagtcaacatcttcctatatgtgactcttttctgatcttttcggactattagtcaacagaatcatcataaagctaaattatctatctgcactgaaattactcagcctcagacatccaaaccagtagctgttcaccaatgaaacctgaataaagctgttgctgactttccctgcttcaatttagagtatttttggaaacatcattgcatgtttaaaatataataagcaaaaggacctttggtaattaaacattctgtaatttaaaactccaagagacaggagcagtgataagatattagattttctttactggggtgaaaaagacagaaagtggttaactgtttaaaaaaagaaagaaagaaagaaatccaaggatttttagagccagaaacagtaacagtgtcctttattctggaaatgtttaaaagcctgtaagcagagatcacccagttcatcctgagcattggtgagcaaataacttctgaaatgctcttgaaagagaattctccagccttctctgtttgaaatacttcctaaagcaaacacaaaagtgggcaaaacacaagagctcatgttaattccaaacaaagagaccaacagtcgcaaattgagagtccatcttagaagcgggtgctgcttccacatcaagcaactattggaaagagtaggggtagatgcagaattaagatcatttgtgactacagaaagagacaagaaaattaatttttaaaactaaaagagaaatttatttcagataatccaaggaaatgagcagagtcaacctaacaggattctcaagcccctccctactggtgtggtgtgaagatcacacgtggtgtagctgacacccctcacatcttccccgcgcccctcctgccacctctttttggcattcaccctctctcgggttctgtatccctgcccatgttctccatgaaaggccatgttaatgcccatgctctttcctgcctctaacagacgatgccttccacagtcactcaagctttaaccctcttctggattcggacctgtacatccaaaagcctgccagacatctcttccagatgctctcagagcacatgaccagaagcacgcgcaaagctctcctgagcctcagtgctttccctccaacacttcttccactctctcagttaccgagccaagacacagagttgcttgtgagtcatttctctacctcatcccccacccaaccttcctgcgagatcctgctcacgttacctcctaaatgctgttacgtgacttcaaccacgtcagctttttatgggggaggagaggcacctgcatatctgtgggagcaccaacctctagacatctcctgccaagttactgcaatgtgcagaaaagaggaagaaagcaagcccaagtcgcaaagtctttgccagtccttctaccaaccacaccttcggtggagatgtgggtctgtggaaatgcagagacggactgaaagccaaatgggccaatgagagctctgaacaaaacattaagcttgtttttctttaaggcaatacgattaacagtggtccattaagaatccgtttaaaaaaaataataataatactttttctgactattgttggggaagaataactcctttatggggagtatgaactcaaagacatgatattgtaaaggaggccttgaagaagagagggactaagaaatgtgatggcgtggtctgttacatgtgcaggtgctgtgtgtgagggaagcactgaggaccactggaggatgagggatgctctgtccttctcgggtatggctgaaggacagggattgcccatcaaggagtaaataatccatgagtggactaaattctttagaaacaggaactcaaatccagtagggattaggataaaaatgtaaactctaatttgcacctctccctctctcccctaagtagtccgtttctataattttatactaaatcaattaaatgtatctgctataatattaatcataattttgtctgaagtagtaacaactggaaactacctaaaagagtcagagcaggactgtaagactatattgtagtctacactatgtcacagcggactgcatcatgatagagaacgatactcatgatttaactgataaacacatatggcaatgaataaaactgtgagtaagatgtctttaattttagcaaaattatcttcattctaattttcaagtaaacttaaagatttatatataaatgcacataatttaattaaaatacatgcatatattaactagaaggctaatcccccaaaatgtccatagatgttatttctgagtgaggagggtcaggaaggttttaattttctttgtactaactctatttactaaaatgtccacctggattaacgttataataaaaatgttaccgtttaaaataaaatgaataaaatacaccggtatgaaggtattattagaacatacgaaagtacaaaatcaagcagcaaaaggaggaaattatattaagaactgaaaaaactatgttgagaattctgtctaagaaacgctgtagcaattaagaaaaatcccagttctgcaagtaatgggagaaagatgatgacttccagaactttcaccatctactaagatgttcaccaattcctaagaagggactgaatacgtctgcatcctcagatctgagagtaattttccacgacgcatactgagcaccataatgagtgaagtctctgagatgacctctctgacctctctaaaacaatcaggcactgcaaacatggcctatcccacactagcccttggtgaaattcaagggcataatattagactgaaacagtgagaagaagattcgacatggagtgcggcaagaatgtgttctagtccttgaaggccagcgctattccaagtgtggtctcagaccagcagcctcagctgcagctgggggcttggaaatggaaacgtatgtgctacgtcctggacctgtggaatcagaatctctgaggtggaccaggaatctgtgtttttaaaaccctgtggttggtaacttcctgctggctgaggacagagagaatgcttagtgaacgctgaggaatgacgggttaaataatccctgaatgattcctgagcggatcaatttctcagccagagttttgaccgcagctgatgatgaacagggctgtgaccaccaggaagggtctgaagaggaggcgttgattgcagttttctgcctctgatcctcaggcatggagccccaccccccaactctcttacacggaggccaaagaaaaagctggaattctccaggagagcaggacctgttaaacagcaaagggcaacccaaaattgtatgagtggccttgccctgagaagctttgaagccagaggttactgaacaactaccctggttaaaaccctaacgtgacaatgataacatgtgactgtatgtggctgtcttcaaaacagcaatgatttaggcacaactgtggatctcagattgttccgtgagtttggtctgataagattgtatgcgtttcccaggggtgccataacaaagtgccacaccctgggcggcttccgccaccgaaatgtattttctcacagctctgaggtcgaaagtccaagatcaaggtgtcagcagggctggttccttttgaggctgtgagggaggatctgttctaggctctctctcccccagcttctgggggctgctgcagtctttggtgttccttggcttatagaagcatcatcccaatctctgcttttgcgttcacatggccttctcctcatatacctgtctgtctccaaatttcctcttctcataaggacaccaagcactggattaggggcccaccctactacatctgcaataaccctatttccaaataaggtcacattttgagggaccagctaaatacaaaacattagccaggcatggtggtgggcacctgtagttccagctactcaggagaatcacttgaacctggattagaacttcacaattactgacacgattcaacccatattaggttgtttagtattatacattaggaagccatagcaaacttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcacccgccactacgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcccatagcaaacttttgtaaacataactatttattaaaatttggtataattaatatttaaatatcctttctggcaagatttagccagttttttaagcttcattgagagaaccacaatattagcattaataatagaatggtctattaattttttaaaaagatactatgtctgcatttccaatataaaattcacagcaatgattcaggtagaaattaaatgaggatgtcattgtcaaccttttaaattatattacaggagcagggagcacacgggccctgaggtagaaatgaataaggaatattctagaaccaccaagaagccagtgtggccacagcagagtgagccagtggtgctggaggcaggtgagatcttgaagggccttggcaacatgaacaggagcttggattttatccacattgccgagggaagtatgaggtggtgtttagcagggcataaatctcatctgatctgtactttgaggaaaacactctgacttctgtgtggagaacagtctataggaagccaagaggagaggcagggagatgagggaggggtgacttcagtctccaggagaatgagctagtgatgtgaattaaggtgctggtggtggaggaagtgaggtggagaactggacactgggatctattttgaagagggagcctacagaacttgttggtggatggctatgagggaaagaggattaaagaatgatgctaggcatttgggcttaaacaaacccctgagtaaatggttatcctattattaatactaagatgggtaatgctagggaaggagtagccttggggagcagtgatgagttattttcttagagagaagccacgttacctataggaggctcaacagagtatcaaattagaataaaatatctaatgttctgatttgtgtctttattttttccattaagatacacatggctggccaggcgcggtggctcatgcctgtaatcccagcactttgggaggctgaggcaggccgatcacctgaggtcaggagtttgagaccagcctggccaacgtggtgttaccccgtctgtattaaaaatacaaaatattagccaggcatggtggtgggcacctgtagttccagctactcaggaggctgaggtaggagaatcacttgaacccaggaggcagaagttgcagtgaaccgagatcacgccattgcactccagcctgggtgacaagagcgaaactccgtctcaaaaataaaaataaacaaaaaccatgggaaagaacaattgaggaaactggggacttgtcctggaacagaagacacgaggacttttggttttttagttttgtttttgtttttgagacagagtcttgctctgttgcctgagctggagtgcaatggtgcgaactcagctcactgcaacctccgcctcctgtattcaagtgattctcccacctttgcctcctgagtagctgagactataggcgcacaccaccatgcccagctaatttttgcatttttagtagagagagggtttcatcgtgttggccaggctgtcctcaaactcctgacctcaagtgatccacccgcctcggcctcccaaagtgccgggattgcagaagtgagccactgcgtccagcaagaatgaggtttgaagggaggcatgattgtgttctcttcaaatagttgaaaggttccatttgaaaaagggatttacttattcctatggttctagtaagttgcagagggtggatctaagaccattgggtgaactttacagagaggccagaaagccttctccaggggaagaaagtcaagaaaaggtctcaaaactgtctggcagaattctgcacaggagagtcctcaattcggtgtagaattggcaagtataataactgtaaatccctctcaatctaccatctacatcattaggcgacatcttcatttcctgaaaattccaacacatgaaggctcacttactatcaagatgagcaagtttgtgctacatagtgaatttgatttcaataggactcattttataccttttaagagtctttaaaacgttgaaaatgtaaagatctgcaagagcaactgatcttcaaagtcccgtcgagtcacaggattttgtaatgatgtctaaagaggaaaattcccatttcagaaaaggctcaatagtatttaatagttagctcaaaaggacgaataaagttctacatgggaagctgctgaactacagtcaggccaaaccttcatactcggagaagatgactgggcctgtagacacagatattgatgataaatcatcacaaaccacagctttccttaattggggtggtgggcagggagagcaggcttcaggttggccttcctccagcaagggcacacacacaaaggggacctgaacacgtggagcttatggtcaggaagcctgaagtgcctgacccagcacatctggtgactagtagtgtagattccccacagaaggaatgacaaggcgtcattattcaaagtgaccttccctccattggaataatcagaaacagctcacaaataaagtaatctgtaagatgcttcatcttctctaggtaacctctccccaacatgatgacatcacttcacatgaggcgacatggttttgtgaggacttttctttccttccaagtttggaatctggctgaaggctaaaatcaccatttacagtgtttgagccctccttcacactttgaagaagggtctgtgtaaatagccattcctacttctcagactcgccagaggcaaaacctgttttgctttggtagtacacgctcttccttaactggtaaaagactttaaaaaaaaataagatgccatttttaattgtttcataaatctggcttagatatattaaggaaattgctattttatatgtagaacagcggcaagcaaatctcaagagattaaaaatcatgttcttgtggttttcttttagaagctgcaaatttgaattcaatttaaaaaatcatggcacagggacaaaataagaatgaacaaagatgggaaaaatgtccgcagcattctgcagagtcaagcgctgctgtgagtgagtgtgcatgtttccaattacacatcagggcttggcgagctccaggagtcaaattcagacagaacccaagtgcagtgcgttacacagaacccaggccaggaaaagcttcacagagtctttctttcaactgaggcaattgtgtagacaatttggttcatttcaagaaaaaaataaaactgacagaagaaagaaaaatattattatattttgcctctcaaaacaaagtcaaattgtgttggtgtataaatcaagattcagtatttccttggctgcttccagaataatagtagatcacaaagagaataagaacaagaaagttcagttctcagccagacgatccaaggtaacaaagggtgagaccctcattccgttactcacaggagcaaacagacaaccaataataattgggcacatgggggtttcaacaagataaactgttatgtgagtccagggtgctaatttctggattcttttgagttgcaaggaaaatatataccgattccccacccccacccacccacataacaagacacaatagttaacagctggaagactgtggttagggggaaatgtgattgtaggcttccatttcaaatgatggaaaatcatttctgaagtcactacgaaagttacttcacaaaactaaaagaagccttgacaccttgtgttatcccatcatctaaagcaattctagtttggaaacacttgattcttggcaggggattctaaagaaggtgccgtatgtgaaaggctggtgtgtcagaaggagctttaaggaactggaatgagaacagccaaaagctaagatttctgattataatcacaggtctggatgtgttcaaggtaaaaagagatcatccccatcatttgcaatattttcaagagaatggggctttagtgacactgatcaaagtctgacatggattttcagctgccttccaactccacatacctgcaattcaatgatctctatggatagtagaagtaactgccaccctgatgttctcatcggtgatttatacgtgaagtggactcaaaagaaatacaacgaaatcccttaataaaaattatgtccattgacccaacaagcttcccagtgctgtatcagttctcaaccgattttagagacatttggtcaaaaatgatctacttgtaataagccatctgagggcactagctctttttcacctctgtgttccttgaagcaggaagtcagtaaaatcactattgaattaaaatgaagtaaagcactttgagatttcagatttctaaattaaggaacacacaacatacggtactttatttgcacaagaattattagaacccagggctaacacccaaatgaggtcacaggtaaatgaaaatctgtctcagttatttgaactcaggtcaacacacagacagagcaaagcaccagctgacctctgatgcacaacccagtgttcttaccatagaattccagaaggcatctcagtcattctcttatgtaaatacaaagacgacaactggtttaaaaattcatttatttttattttagcttctttgtgtcaaactcaaagaagcctcacataaatgatcaaagactttttggtggatcttccaaacgtacatgccgggaaggcctgcttgcactttttccttcaatcctctaaaatgaaggttttgaagatgcttgccaatggaacgttgtgccttacagctataatattttttaaaaggcattcagtttaaattaatatatttggccagacaactgtattaaaattcttgttgttttttctgttataatggtagcctgtggtatgactagtcttcttcaaaaatatgtacagttattgcttctctcttgcctggggtatatcatgtgtttttcatttgagtgtacattgcaatacctcattaaaaccaacacttaggctacacaaaagtcttcatatcatgccgcaaagggcgtaaactaacgtggaaagtttcagagcctcataactcattgcatatacctcttatactagctgctcaactgatatttagctctcctggatgatgtcacagtttttatcctcttaaaatagcctgccttcagaaaatatatagtttccttcatgcactaatcatggggagttacgatgtaaatagagccattttttttcttatacaaggaacaagtgctctcaccctcctcccttctctccctccccatacacagaagcacacttcacttcacttatactaaacacttcacttatacttacactgcaacaaagagttgcaaatacatgcaaataaagcctttataactcccctctctcctgctggacagctccttgactcaagtatttccgaagacagacactctgataagggtctgctctgagcttcattctcagcatacagtcctgggattatttacctaccaatattcacctctgcatgaaccagtaagtcattactgacaagaaaaaaacaatttgtgattttttttaatgtcacaatttttctttttaaggtttgggagagaaagttgttttgaatgtttcatcagtttctattgccaaatgaacacctgtttcagagtccctgaaagtcacacatcagaagcttctgacttcaacatatagtctgctttgaagaattattttaaaaaagcattgactgcttgaagataagcaagtgacactcaatagcttcattctttagtcttagaaaataatttttacacttcacacctattaggatggctactatgaaatataaaaaaaattaaaaataacaatggtggcaaaaatatgaagaaattagaacccttgtgcactgctggtgggaatatcaaatgatacagcctctatggaaaacagtatggtggctcctcaaaaaattaaaaatagaattaccatatgatccagcaattctacttctgggtatatattcaaaaaaatttaaagcaggatctcaaagagttctttgtacagccatgttcatggcagcattactcacaatagccaaaaggtcaaagcaacccaatcgtccatccacagatgaatgaataaacaaaatgtggcatacaataaaatgtcattcagtctttaaaaagaagaaaatttggacacattgtacaatatagatgaatctttttttaaattaaagtggtttttttaatcgttttattttaaagttccgagggacatgtgcaggatgtgcaggtgtgttacataggtaaacgtgtgccatggtggtttgctgcacctatcaacccatcacctaggtattaagcccagtatgtattagctattttccctaaggctctcccacccccaccatcccccaacatacaccatagatgaatcttaaggacattatgctgcgtgaaataaaccagtcacaaaaagacaaacagtgtatgattctacttatgtgaggtacctagagtagtccaagttcagaaagtagtaataatggttgccaaaaggtgggagcatgcagaacacggggagtgttgattgacatcaagtttctgttttgcaaggtaaagaagttccagagatttgctgcaccaacaatgtgaatatacttaacactactgaactgtaaagtggttgtgactacagattttatgttttatgtgtttgccacaaccaaaaataaagattaaattaaaaaataaaagattttatagcacctatcacttaccaaacccactgtacatcttacactcgtgaatattttatgattttcaaaacacctttatttttttcccttatttgttcattccttcatgtataacccacaatgtgttaggttatgtgctgggcagcctggaagacccaaagacgaattagggaagtaccctatatttaaagccttgcaaggacataaatatcagtaatataaagtaaaatatgttcactgctgaaaactgctatacttcctagatttttcaattcaattgcaatttctaatattttgccatgttgatcccacaaattcacttgtgtttaaaagttaacgtgcttgattatcatacagctgcttctttcataagaggaatacagataaaacgctatgggatttcagggggagaaagaacttcttattaaattcatattttcaaccaataagaaaacacaattttttttaatcaacactatcttcttggtgcttttttcacatctcatcctctttcctcctttaccctgcctaagcaaccatttctggacccaatcttgggttattacatctgacggcaagtgttatgtgggccatggaccatgagcaattagccccctctctactcctagggatggagtacatgtgatgatttccatcagactcagattaaatatcttgctggtaagttacccctaaaaatcgattaatggactctccaggtagacactgaggtaatctccaaccaaacctgacttatacttaggggctttggaagcccaccagagtcatcaagccatatctccacctaggctctatactggaaagctggtcagtagtaacacaaagaacaagccatttgggaaaacagcccacatgaaaagaactgtggtttcaagaagagtcattccatcccaggtttaaaatactcttctcctctttatctaccttgaggactcctatctatccttccataccagatccagcctcatcttctaagtgaagccctcctctgggacgtcagcgtctcctctgcatcccctagcattttatgcatcctctgttaaagcaactgtttgcacagctgtatccaccactaaacttagaggcaacagaccatggttttgaatgtgtagaacccaacacagagcccgagacctagtgggtattcagtgcatgttgaagggaagaatgaatgcatgagcaaacaagacaatggaagtctgtcatcagtatttacatttcaaaatgcaaagtgaaaattgtgcaaatctctaatcaagctgtactttaaaatgctaaattgatttggctaaaaatatttcaacactgaaatttctttttgcaagttaagtcttcgcataaccaaaacagaaaagaacgtatcaatgaactaaatagataaatttatggctgacaaaatctcaagatttagtgtgtgagaggaaagtaaaattcaatgtgtccttgaaagttctggggtctaagatatacaggccaatggaatagaatagagacttcagaaataaactattgcatatatggtctgataacttttgaaagtggttcaaagatcatttaatgagaaaaaaaggagtcttttcaacaactggtgttgggaaaactgggtatacatatgcaaaagaaaaaagttgggctcttaccttatactatatacaaaaattaactcaaaatagaacaaagaccaaaaaataaaagctaaaactctaaaattcttatgagaaaactctaaaatgcttagggaataacttcataacactggatttcacaagcctgtcttgaatatgacaccaaaagcacaggcaacataaataaaagagacaaatttgcctgcactaaaattaaacacttttgtgagtcaaacaagctatcaacaaagtcaaaagacatcctataaaataagagaaaatatctgaaaataatttatctaataagggattaatatccagaaaaaaaaatatatatatatatgtatataacctacaactcaacaacaacaacaaaaacaacccaatttaaaaatgggcaaaggacttgaacagaattttttccaaagataacactaatggccaataagtacatgaaattatgctcaacatcactaatcattgggaaaatgcaactcaaatccacaatgaaatacttcgtagccattagtatgactattaccaaaaaatcagaaaattacaagtgctggtggagatatggaaaagttgcaaatcttatgcactggtggtgggagagtaaaatgggaaagtcactataaaaaacagtctagtgattcaaaaattaaaaatagaattaacatatgattcaccaattccgcatgaagatagcaggaaattgaactgatatttgcacatccatgttcatagcagcattatttacaataaccaaaaggtggaggcaacccaagtgtccatccacagatgagtggataaacaaaatgtgatatacacatatcatgggatatcttcagccttagaaaaggagagaaattctgacatatgctataacacagatggacctttggaaagttaagagattgtcttatttatcttacgctaagagaaataagccatccacaaaaggacaaatgctgtacgattccacttgtgtgagttacctagggcagtcaaattcacagaaacagaaagtaaaatgatggtttccaggggctgagagaagggtagaatggaaagctattgtttaatgggttggagtgtcagtgtaagaaaatgaaaaaagttctggagatggatgatggtgagttttgcaccacaatgtgaatgtatttaataccactcaactgtacactaaaaaatggttaggatgataaattttatgtatattttactataacaaaaagtcataaaaatcaaacatggttcttctcattaaaaaaaaaagaagattcctgggtctagttggttctccctccttcttagttcttggatcaaggagatagaattgtgtccaaagtgaccaagtgacctacggagtaatgggcttccatctagccactccctgctttatgactgagctgcactgggagaggcattgtcaggggaaattccaggtttctagaattggtatctagccagaatttgtcccagggctaagtggctaaggcagtgaactagtctgtcagcttctctgttttaaatggagtcatgtaattccattacataccctttgctttcaactatatggccaaacatgactggccagcaggctgggggacagaagacatgtgggcttgtgcttgttacctggaattgaaaagagctcttggcatggttcttgttcaagctccatggttgactagcacatgaccaccaagagagctactgtacttctccgagactcattttctcttctgtaaaaaatgactgagtttctttcacagtgcataaatcttttcctccaggaacagagactgcccagggcctgtccaagacaactaggaaaccagagcagcagttaagccattcctgggcaggaataaatgagcagatgtcagctctcagaatctcagttttctcactcataaaatggaaaagaatactatttcttttatgtcattcaccatattgtgagctgaaggcactttaacgatgctgaggctgtaaactaatgcataatgtgatgtttatcattcttcacctatgttttagttactgagcatctcctgacaccagagaggacgcaacaaaaatcacaactcctagaactgcacagtctaaatggcaaccactagcccctgtgacaactgatcacttgaaaagtgagtagtccaaattaagatgtgctgtaggtgcaaaatatatgctggatttggaagatgttctatgaaaaaagtatctcattagtcatttttatattgattacatattaaaaagattccattttggctatgctggactcttcagatatatcctgggagattgtattaaaagaaaatacatgatggaaattagtgtaggtagttactagaaaatgtaaaattacatgattcacatcctatgttcactgttctagacatataaatataactttgagttatttttaagcatgagaagacagaaatcgacgaataaagtgaaaaagctaaagattaaagatacttacaaatcattgttgtattttttaagaggtcattttgagcatattccttaccattgaagcccctgcctgtctggctcctctgcccaccttgttttgctaatgggtcatgctcctatatgtgcatagacgaggagcggctctcagggactgaccgtaagcatagtcagcacagcacgtatacccatgctctgaccccaggttggcgtcttggagggtgaagcattttcccagtccttctttgactcatcacagaggtataaaacagcgtctccaacacgtgatttttttttttttttttttttgagacagagtcttgctctgtcgcccaggctggagtacagtggcacgatcttggctcactgcaacctccaactcccaggttcaatcaattctcctacctcagcctcccaagtagctgaaattacaggcacacaccaccacgcctggctaatttttgtattttagtagatacggggtttcacaatgttggccaggctggtctcaaactcccgacctcaagtgatccacccatcttggcctcccaaagtgctgggattacaggctgagccactgtgccagttaaaagaaaaaaaatattcaaacatatttggtttcttattgaggtgaagttcacataacatgaaactaacagttttaaagtgaacaattcagtagcatttaattaacaatgttgtccaaccaacacctctgtctagttccaaacatttttgtcaccccaaaaggaaaccacgtgctcagaaggcagtcactccacatcacccctcttcctagtcctatgctttgcacacaactgactcaccctgacagttataacctaaaagttaaataaaattattagtaaactgcaaacccctggcaagtgaattacttaatatctcttaaaatcctgacatcaaatgattcccctgtgaggccatgagatgataagaacatccacctccctctcttgctccagtggaatgaaaccccctcctcaaggagggttacactcaggcataggcccgatcactcatcatatattgacagatgtgcaggcctgagaccccgccttctggagctttctaatgctccttgtttctcaatccaatccttgctaggaattaggctcttctgctgaatgtaaaatttttccatctgcctccataaagtatgtgccacctgtcagctgactggtcaaccccaagctcaaagtatatggacattttgggggtgacaatggtgggcatacatctttagcaaagattaagaaggtaccagaggaggaccagcacaacccagcaatgcagcagaatccatcaggaaagctttggctctgggtggagctccttgctttagctctgcctttgagcgcttgggtggctggggaggcactggggtggaagggaaggaagcaggaattcgtgtgctgcaaatttcactacacttgaccacaacttggagtggaaagggcactgtggtacgtctatctggccttcctttacaagccttaaaatgctgtggaatccatctggatggaagacgccatccaattataaatccttaggatactttttattgccctttaagagttccgatgcttgctcttccatgcccatatgtttctgcttaagaggcttcattcaaatcaaattggaagagaagtccagattacccaactacaattacctgagcaaaaatcccctcaattatcttggtaatccagataaattcggagtacaaaggtgagttgcctggatagcactggctaagaactgctttgtctcccatttcaccttgcattattataatctacttgattacacttcatttataacaatagggagggcttgttttatgccacacattgccacttgctcaagtgtaaaataaaccttaaatgactgatgtactgctaaatttatctcaaaaaacaatcataacaggaatcttaaggcaataaagtcaaacaaatagaattttacagaatttaaaaattattttgtgagtgatttatgctaaaatacctcaaatttatttcaaaaacagtcttacttaaaactgacttaaaatatatgtaggataaataatttgtagtgaatttaacgaaacttcagcaattcaaatgaatgcacattattcttcttaaaaacagatatcctgaaaatatccatcaggataaatagctaatgcatgtgtggcctaatatctaggtgatgggttgataggtgcagggaaccaccatggcacatgtttacctgtgtaacaaacctgcacatccggcacatatatcctggaacgtaaaattaaattaaatttttaaaaagcagatatttggaaagtaccaatagcttcaaagtaaaaatactctacactgtttttgtttgtttgtttattttcgtttttgtttttcttttttgagatggagtctcgctctgttgcccaggctggagtgcagtggcgtgttctcagcttaccacaacctctgcctcctgggttcaagtgattctcctgacttggccgtgccaccatgcccagctaatttttttacatttttggtagagatgatggggtttcactgtgttggccaggctggtctcgaactcctgacctcgtgatccacccgcctcagcctcccaaagtgctgggattacaggcgtgagtcaccgcgcctggcctatgcactgttaattttatcacgacagttataaatccatcaagatgtcctgtgatttttcaacacaaattactcaaattatgaacttctctgtgtgtattttccactggcttgtttatgaatcctgctgatatgtctgctacaatttctccaaaggctaaaagatgtttacaggacaaatgacatcatgaccatgtcaggcttaaatgtgtttatatcagttgggtttagagggtcttcaaaacatggctttaaaatctcagttattatggagcttaatgtgttcctgatgtttctggagtaatgtatttctaaaaatagagaaatagattggttaaaagaaaatgaattgttggtctaatctgtcttatgcatggctaacgaaatgcattttcactctcttccgtgataatacgacacttaaaactgtgaggaccaatggggtgataagagacaaaataaacagtaaatagatactccatgtgagttactactctgtaatagatagaaaagatattttatagaaaagggaaaatacccacagacatataagcaatgtcctgtggttgctatcaaatttactgttagctgtttaaaactgccttaaaggttttttaaatgtgtcttttctaccatagattctttagacgacagccatcaagcagcaaatacctcgcaggaggccattgtgtttctatttgaacttctatggatgtcaagctctgttcttcaaaatttagccctacagatgggtggcccaccggagagaattaatctcactatgcagccaacactaccctttctggatctttccccagtagtgtggattctgctctagtccagaattatgcagaataagtatacttcatcttagacaccataattcttcaaatatctaaaatgtatattatgctctccaaatcctggtcatctccaggttaagtatctctcaaaaacagtccatcagataatatgattttaaatctttatccccttggtcatatacccacaatctcattctatttaccaatatccctactgatgcataaactacatatgtatatgtgtgtttttttttaaaaaaaaagcaattccactgtaattttagcagaggttatttccacatagagctatgtatatgtgtatatacacatatctttatattatatagttttctgtgctttcccagttatctacaatgggcatatatgacttttatagccaggtaattcaatattcattcattcagtgaacatcattgagcatccactatgggctgggaagtgaggatggagccacaaacaagcaaaataaaaacccctgctcttgtggagttcccttctcattggaagagacgtacagtaaagaaaaaaataaaagagtaaagttaatagcctgtgagaaggggatataaaagtgggaaggaagacagggtgatgtgtgagaaacactttttttttttttttttcagatgaagtctcactctgttgcccaggctggagggcagtggctcgatctcagctcactgcaacctccacctcctggtttcaagcagttctcctgcctcagcctcccaagtagctgggacttcaggcatgcaccaccatgcctagctaatttttatatttttagtagagacaggatttcaccatgttggccaggctggtcgtctcaaacttctgacctcaagtgatctgcctgccttgacctccgaaagtgctgggactacagcaatgagctgccaagcccggcctggggaacactattgaatagtgtggtcagggaaggctttactgtgaaggtgatgaagacccaaagaaagtgaggaactaagtcataaatgatgggtagaacattccggattgcgggagcagcaagtgcaaaggccctggggtgaggaataccaagaatgtttgtgtgggcagagcagaaagaaccaagggtaaagcattaggagatgaggctgaagaagtaaccgggatcaggtggttagggccctcaggccctggaggaaggctggcagcgctggagccacatggactgacaatgtctagcagtcatcccggctccctgtgaagaacagaccctcgcttgcagagaagcgaggacaattaggaaagcagagtcatgatccacgcacaggatcacggtgacttggaccagaaagagagcagtggagctggggagtgactcttttcagtatttctcaggtggtaccagtgggatctgcagagaatacatagttaaaggaaatgtctggaactaaacatgactcttcaaacgtgatcctactgtggcagaagagaggcgactttacatttcctttcccaggatatcttattctaatgaacacagaaaccgtaaaatcaagccaaccaacatgatgaaaatgattatataaggtacacagcccaggctggatttgaactgatgagggaaaaaaaatctctagtgaaaattcctctctctaaccacagccttctctccttccatctctgcctcacccttgctctttctgaagccttcctggatgctcatgaagctctctccttctttgactcatcctattttcccaggacctttatcaactcagggctcttctcccctccccacagtcagctcactgtgctctgactagttccctgaaattgctcatcctcttactaaccaggaagcttctacccgctcttggtcttctttctccaccccagtgccaaagaactaagcactgatggagaaaaagcatgcggctaatactgtctgtctctaccacaaatctcataatttttaaaatccatttggaatttacattcactccttaacttcttttcattcactcctaattcacttcctatataattctctacacagctgctgaaaaccttcctttctgctgcctcttaccccaaaactactctcacattactcacaaaggttgaccttgttttctatatacttttttagagtaacgaagccataaaatgtaagttctttcaacctggacctcccactcttgggatttctcaatagcttcacctgtattctcccccttcactcttgactcagaggtaaacgctcccttgctcccaaatcctttagcaacgtagggttgataattgctcctttccaaatttaatccctgcatctgcgcccctgagacagacactgccatgatttcccagcttgctgtcttctccctcctgcatctcctccctttctctgtgacggatattttccctgtgcaagagaaatttcttctgccctaaaataaataatccaaaacatctcttgactccacttaagctaacattcaatatctcactttcccttgtattaacaaaagttaattgagtcagtacggtgctacaattctcagacacaacgataaacatgatagagaccatcaacatgccttggcattttgcctgctttctcttcaattacttgcaacttggcttctactgagctccactgaaaaagctttcatgacatgaccacatccaatcccaaagaaactgtccccttgcccagtggtcttcaaaaccctccaactccacagtgtctcattaactccaactcatttcctactaaacatctcttctcagctcttcaaagtcaaagattgcgaaccaaatctacagacttctcctctcttctcctttgggtccaactccatccttctccatgaaacttcttattcctagaaatggtgtctgcaccttttaggcttccaggcttgagcctagagtcatctttaactctttccatacccagactcccaagacccagtcagctgtttaggtgtctcctctgtatgcagcacttactgtcattgccctggtccatctcccagagcccacatcttgtcccactgtctgcaaagcctttcctatatgctggatataagtgcaaactccccctaaaatcccattgaagtttttacttttttctatcttctttttttacttctttttatcttcctctactcacacagaagtgctccaattatgaggaccttattttattccctttactgtcaaacacaaagccaacatgccatacgaaaagatagtactgtgcttccttcagtgccactctagcacgcccactccagcacacccttcttgtgcgggtgtatgctcatgtgatactatcacaggcaacacttactatgcaatacgttttccacaatcacaatatttccacaatattgtgatatgagctcattcttcaggccttgacacaagcgcccacaaacctaagagaatgcattttcatttttatgatacacagttttcgactgctccactctggctgccaaggcattcctcctccaaatcacgatgtctatatcaaaagaagaacaatgagggagagctggaggtagcgctaagaaacaacctggtccagctcccaggtctcatagagaacactcagaacacgcttgttagaggtatctgctcctggcctcagcttctcagaagcaattacacatcttctgggtaaacgtggagtgtgcagcacagaataccaaagctgagcttcccattgtacctggttgttgatctcctcgttgacctccctcagctgaatatttcttaagaacagtgttcaattaatccaactatccctggtggctggcaggatgaatcagttatgacttatttcatgtttgtgggtgggtgtatgaagtggtcctcaaaggagatttttgctctctgcagacagtctgcctgtctgtaggtcacttcctgccatttcctttgagtgggaatatgagccagggtgttggaagaaggaagagtccaaaagatgtctcagggaatgtcccatagccattggcctggtctgccctagataacttctgagccaggtcaccctaaagtgctacatgaaaagtcatggattttttttctaacttgttgatctcaaatgtcgtgatttggcatgaatatctagcttcccatgttgcagctatggatttattcttgccaaaatattggggattgggctggagagggaagaaggtacgaagatgcattctgtgttgctcaacaagatctgcatggcctcaaccaatgcgtgtttgaccatatggatatttacaaaccccaccatcaactcaccaaaatgaagagtgtcttagacttattctcacaagacaagagggaacgctgcctctaaggagtctctctgggacacctgggagagatttatttaatggtaaagcaaggaaaggaaaagatgaacagtgacctgcaaatcattaaagagggcgactcgatcataggcaagggcttttattagtgctaaaattccacttcaaagtttgctgattcatggatgctttttgttttgctgtttatgttgtagaaactgatttgattttcatagacaaaataactaggcatttataaccacatataggtatgaaagaaagataaaatgatgcccttagcccagtcagaaatactcttaaccatcaaaatagttccctgaatctaataggccaacaatattccaacaccagaacctttgctaccatagccagaatttttaagactgcaccactgttaagtagaggcaatttttaatacttagggtctaaccacaaggcataaaatgcaaaaaaaattacataatcctgtactttttaataattaaatgaaaatacatagactctaagcaggaaaatatctgagatccttaaaacggtataatcataattgttctacattggtaatatgtgtgatgatatttttctccaaaaaaaattctctaccatttcattctctttaatttcttctagcccgtaaggtctagcaaagaggaatacctgaaaagatgcaaattgtacccctgtgctgttcaatgacagcaaaaattgcagctccccaaccccacctcttatgtcccctgagcaatctgtgatcacttgagggtgaggacagtatattgccccaataaactggctttccaccaagtaccaccaagaaatcaaaacagcttttattttattgtgtcatcatatataagttaatagttcataattagttcaaaatttaaaattatgttctaaaaataaagctttctaagtcaatgtaggcaacgattccaagatccttatagttttcctctcttaaacagagaccattatcatatgatttttttttttttttgagacggaagctcactctgttgcccaggctggagtgcagtggtgcgatctctgctcactgcaagctctgcctcctgggttcacgccattctcctgcctcagcctcccaagtagctgggactagaggcacccgccaccacgcccggctaatttttttttttttttttttttttgcatttttagtaaagaccacgtttgaccgtgttagccaggatggtctcgatctcctgacctcatgatctgccagccttaacctcccaaagtgctgagattacaggcgtgagccaccgtgcctggccagtcatatgatttctaaagagaaactgaacagttatttgtagaaactctgcaaagcatgactttgggacgggcacagtggctcacgcctgtaatcccagcactttgggaggctgaggcgggcagatcacgaggtcgggagatcgagaccatcctggctaacatggtgaaaccccgcctctactaaaaaaatacaaaaaaattagccaggcatggtggtgggcgcctgtagtcccagctacttgggaggctgaggcaggagaatggcgtgaacccaggaggcggagcttgcagtgagccaagatcgcaccaccgcactccagcctgggcaacagagcaagactctgtctcaaaaaacaaaacaaaacaacaaaacaaaacaaaacaaaaaagccatgcccaagcccacccctgaccagtgaaatctccgggattggggcacaggtataatgtttttataaacatcttcctagatgtttcctgcatccagggtgataaatcatcatactaaaggcatcatctgaaggctcctagagtatagagaagttcagaataaggaccccaaactattgcacatcctgacactaactagctgtagctgtgcaccctggacagggagagatctaaacagctagttatcttacttcaccgaaatctacaactaaagatgtctatccacgtgttatagctttggcttccctaatctagatgttcaatctacttttctgcaatttggcaaagtaaaacacacatatacagtaatgcacaatgtcctgattgttggggtttattatttgttttgcatttacgcttcttaggtatgtaacatgccaaagtcatgggagctgagtcttttgaaacagaggcttctttgggtgcaaatattaattttctatgaaaaaaagagaaagtacaaagaaaagaaaaaacagcagtaatacagaaatgaatatcttccttgtctaggacacagtgttttttttaacctagatttctttgaacacagactgacacaaaaattaaatactattgctccattggagaggtgcaaacctggggcggtgagagtgaggggaagcgagtgagattgtcactacactagcttctggggacatggagacagccagtcactgagcccctgccttcccttggccatgcagatgcctctgataggttacacggaaaaattctacctcacagcagcccatggggtggaggaaaaataggaacttagttgcctacattcttcctgcatccccttcctcattggtcagagtcaccctgcatgtctgggttgtcacctgctcccaaggtgaccactccaaaagtcaggttctacgcccggtggtggggtgcttcatccaagtacagaaatgccaagaggatccggaaaccttttgacctggttgctgagtcacaggaaagaagggccagccctcctgggacaggtaacaggctggccctgagctgtggaagccctcacacccagaaggagtcaatctgctggggtggccactgagaccaagcaggagctgagggtcctggagtaatagatggaggcccatgagatgtgttcagacacatagtgtgtttgtcaactgcaatgtgtgtgtgcccccaaaattcatgggtttaaatccttacccccaaggtagcagtatgaggaggaggggcctttggaaggtgactaggtcataaggatggaggtctcatgaattgcattagtacctttacaaaagggaccccagggagattccctcacccttttgtcacagtgtgaagacccagcaagaagatggacatctatgaatcaggaagagagccctcaccagaacccaaccctgctacactctgatctcagacttccagcctttagaactgtgagaaataagtttctgttgtttatatgccactcaatgtatagcactttgttacagcagcccaagctaagacagcctattatgtatgagcaggtggctttgagataattgagaaaacagagactataactacaaccagccagagatgggatcattgcaaatgggactcgggttcacacaaggtttgtgacacacacacaaaaaaacataaggcagataaatcagcaagggtagcagtcaggaattgacagacgattaatggattgaggaaacagaatagataatttaaaagcaaacctttgtacacaaaagaattcaggaggtgataaaagtaacattttcatatcagttggaaagtaagttattcaatagcaacagaacaatcatttattgaggaaaaataactatttctttcctggttcaatcttggggtgttgtatgtttccataaatttatccctttttttctgggttttctaatttttgtgcacagaaatgttttttaatagtctctgaggttttttttttatttctgtgggttcagtggtaatgtcccctttgtcatttctgattatgcttatttggatcttctctcttttttctttatcagtctagctagttgtctatcaatcttatttattctttcaaaaaaccaacttttatttttgttggtcttttgcatggtttttttgtatctcaatttcattcagttcagccccgattttggttatttcttttcttctgctagcagtaagtttggtttgctcttgttttttctagttcctccaggtgtgacattaggctgttaatttaagatctttccaactttttgatatcagtgtttagtgctataaactttcctgttaacattgctttaactgtatcccagagattctggtatggtgtatctttgttttcatttgtttcaaataatttattgatttctgtcttagtttcattgtttacccaaaagtcattcaggagcaggttgttcaatttccatgattttgagagatattcttagcattgattttatttttaccgtgctgtggtctgaaagtacggctagtatgatttcagggttttttttcatttgttgcaaattgttttatagccaagtgcgtagtcaattttgaagtatgtgccacgtgtaggtgaaaagaatgcatattgtgtcgttgttgggtgcagtgttctggagatgtctgttaggtccatttggtcaagtgtcaagtttaggtctcaaatatgttaagttagttttctgccttgatgatctatctaatactgtcagtgagatgttgaaatctcccactattattgtatggttatctaagtctctcactaggtccctaaaacttgatttatgaatctgagtgctccagcattgggtgcatacatatctagaacagttaagtcttcttgttgaattggaccctttatcattatataatgcccttctttgtcttttttgatcattgttggtttaaagtctgaaattgaaacgctgaacagaccaataacgaattacaaaattaaatcagtaatataaagactaccaaccagaaaaagccctagaccagagagattcacaaccaaattctaccagatgtataacaaagagctactaccaatcctactgaaactattacaaaagatttaggaggaaagactcctccttaacctcattttatgaggccagtatcattttgatacagaaacctggcagagacacaataagaaaagaaacttcaggccaatattcatgatgaacagggatttggaaatcctcaacaaaataccagtaaaccaaatccagtaccacatcaaaaagctaatccaccatgattaactacacattattcctgggatgcaaggttggctcaacatatgcagatcaataaatgtgattcatcccataaacagaactaaacacaaaaaccacatgatcatctcaatagctgcagaaaagacttccaataaaattcaacatcctttcatgtttaaaacactgacaaactaggcattgaaagaacatacctcaaaatactaacagccatctatgacaaacccacagcaacactgtactgaacaggaaaagctggaagcattccccatgagaattgaaacaagctaaggatgcccactctcaccactcttagtcaatatagtactggaagtcctagccagagcaatcaagcaagagaaaaaaaaaaaaaagaaacaaaatacatccaaatgggaagagaggaagtcaaactatctctcttcacagaggacgtgatttatgtctggaaaacctcattgtatctgtctaaaaactcctggatctgaaaaacaatttcacaacgttttaggatacaaaatcaatgtacaaaaatcagtagcatttctaaacatcaacaatgtccaagctgagagccatatcaagaatgcaattccattcaaaatagcaacaaaaaaaatacaatacttaagggtacagataactggggagtgaaaatctctatgacaagtattacaaaacaaagatcaaagaaatcagagatgacacaaagaaatggaaaaacattccatgcccatggataggaagaatcaatattgttaaaatggccatacttcccaaagcaacttatagattcaatgctatttctatcatattactaattacattttcacagaattagaaaaaactatttggaaattcatatggaaccacagaagagcctaaatagccaaagcaattctaggaaaccaaaaagctgaagtatcacactacctagcttcaaactatgccataaggccacagtaaccaagacagcatagaactagtacaaaaacagacacataaaccaatggactagattagagaacccagaagtaatgtcacacatctatagtcatctaatcttcaacaaagtagacaaaacaagcaatgtggaaaggattccctattcaataaatagtgcttggataactagctagccatatgcagaagattgaaactagactctttcattttaccatatacaaaaatcaactcaagatggattaaagacttaaatgtaaatcatacaactataaaaacctagaagaaaacctagaacataccattctggacataggccctggcaaagatttcatgacagactccaaaagcaatggcaacaaaaacagaaattgacaaatgggacctaattaaactaaagagcttctgcacagcaaaagaaactatcaatagagtatacagacaatgtacagaataggagaaaatatttgcaaattatgcatccaacaaaggtctaatatgcagaatctataaaaaaaaacttaagcaaattaacaagcaaaaaacaacttctttaaaaaaaatgggccaaaaaaacatgaaaagacacttctcaaaagaagacatgtgtgaccaacaagcatatgaaaaaacgctcaacatcactaatcactagagaaaagcaaaccaaaaccaccatgagatatcatgacacaccagtcagaacggcaattttaaaagtcaaaaaataacacatgttggtgaggctgcagagaaaaaggaacagttatatgctgcgtgtgtgaatgtaaattagttcagacactgtggaaagcagtttggagatttcccaaagaacttaaaatagaactaccattcaacccaataatcccatcactgggtatataaaggaatataaattgttctactgtaaagacacctgcattattcacagcattattcacaatagcaaagacatagaaccaatctagaagtccatcagtggtggactggataaagaaaaaaatgtggtacacaaacattacagaatactacacagccataaaatagaatgaaatcatgtcctttgcagtaacatgaatggagctggaggccattatcctaagggagttaacacaggagcggaaaaccaaataccacatgttttcacttataagtgggagctaaacactgagcacacatggacacaaagaatggaatgatagacaccaggggctgcttgagggtggagggtagacgaagggtgaagattgaaaaactaccaattgggcactatgcttattacatggtttatgaaataatctgcacaccaaactctcatggcatgcaatttacccacgtaacaaacgtacacgtgtacccccgaacctaaaataaaagttagaaaggaaaaaaaaaaaactaaatccctatctcacattatacatctaaaaaatccaaatagattagatttaattaaaaattaaaccataaaacacagaaagaaaatacagatgaatagttatataatttaggatgagaacagcctctgtcaggatgaactaaagaattcacaaaaaaaaatgttaacaaattaaatgacatgttaaaaatctggccaggggtagtggttcacacctgtaatcccagcactttgggatgctgaggcgggcggattacctgaggtcaggagtttgagaccagcctggccaacatagtgaaacctcgtctctactgaaagtacaaaaattatccaggcatggtggcacacgcctgtaatcccagctactcaggaggctgaggcaggagaattgcttgagcccgggagacggaggctgcagtgagctgagatcatgccactgcactccagcctggctgacagagggagactctgtctcaaaaaaaaaaaattaagaaactatatattgaaagactataaaaaatagttttggtttttttctcagtaaaaaaataatatatccattgtcaaaaattttctattttcaatattattatttaatagaaaaatttcaacaatttctggagaaaatatatgaaacacatttgacagagttttaacatccttaacataaaggatgtaacttatatgttacatccttaacataattttctttgttcagttaacaagtttttattgagtatctatattgaaatatgcactatgtctgacactggcaacacatttgaggaaataaagaagaaaaattcaagtccacatggaaaaatggactaaggacatgaaaaagtataaatcatcagtacacttctaataaagttaataatcaaagaaatgcaaataaatgtgacctatcaaggtcttgctatttgtactgtcaaattataaaaatacaataacaaatattggcagatattggggaaacaagtaatgtcatatactggtatgtgcttaaactggtaaaagtcttcagaaaggaaattggaaatatatgtaaaaattttggacagttgcatattctttgttctagaaattctacttatatgattagaacctaaggaagttatcatagatttaatcaaagatagttacaggatattcaacatagccctgtatataacagccaagaatctgaagccaacaaaaaatatttagcttaaaatgtatagaatatacataggatgaaattgcataggtcactaaacagtttctagggacatggaaaaaaaaatgccatattgcagaaatgcaatattttgggatgataaaagggcagtttcaaaaaattgaaaaaatagcagttactatgacctcttttggcaaaaataattatatgtaatattgttcatggaaaaatagactggaaatataacgattaaaatgttaattgtatctgggttggtgagattacatataattattatatataatctttacttttttagattgttgttcacagtgacatcaagatttgtcatgggagaaaaaatgaagaagattattattttgtagtcacccaaggagagaagaagtcacatctctggagataggaggagatagggcatatgagccaatcacatttctgcagccttttgtggatacaaaaggggtgggccaagcctttccaatatcccttttcctccttggtacccagacagactatatttaccagcctcctttgcagccaggtgtggtcatgtgactcattcctggtcaatgaaaggtagatggaagcctggcctaggaaacaggtctacatgcaatcttccattcttctcccacccactggctgaaaagaaaggcttctgaggacacagagtggggggaaggctaggtagaggctggatgggaagaaagcagggttctcttgctcctctcatcagagagctactgaggagacccaccgcacccagacccccatactggactgttacaggagtgagaaataaactttgtttagaccactgaaatttgagagttagagctattagcctaccctgattaacgctggggtagcccctcacatctgcccagcaccctcagcagagcctaacccaatcatccaaggttacccaatagagaactcaggcttccactagagtagccgtcacatagagttactgggtcttccaggttctgccacctccaccgtgttttgtgggactctccactgaactcacaaagcacatgtattcagctactccaaagctatgtgtactcaggaagagaaagttctaaatgtttctgtgaccttgtgccactgatatcatgggttctatccttcagagtgctaagaaaagtgttaaatctccagaatagctttggaaaagtggagaaatttgagactttctctatttttagttgctaatatgcattcctgaaaagtttatttaaagccacaaggaaatatttccatattgaatttcaatattgcaatatactattttagaataaaatggaaagatccaggacatagagcagctgagaagctacacagttggcccctgggcttcactcagacagtgcttctctaggctgcaagtcataagtctttgtgtcacccacttttagaagacatcccccggacttctgggaccaacctgaggtttgtaggaatctctgaggatcaatgatcaaacatatattagcttgaaaaaaaactaatatatgtgtatgtttttttaaaaggttaagtttttaacaatttagacgtcttggcattatactctgagaacgttaaccaatgagaataagagtgacaatttagatgtaaaacctcttaaaggtaaagataaaatcctaaccacatggggaaaaccatgtgttctgtggatgatttccctggatttctcaaaagactcttagaatgttctgggtatgactttgggggcatctgttctatgaagatgggcaccccagcatcacctgcatattaacccttcttcttgctcctaaagatgcagaattagctgagattaggaagatgtacaaagtgttctccctgcacttcaactaatgaacaaaactttttaaaaattacttatgatttggaactattttatcattttatatatcctatggcaactggcattttatatttaattttatcatcttttgctttttttctttgatctaaatcaggatgctaagttttgggggggggtcctacagttttggcagagacctcattctaaaaaagaggtaccagactattaaggcagaatctgctgagggtggccccaaacctggtctggtgaacctcactcaactcatcattgatttcaagggcacagaagaggcaaggagatgacagcaggagaaatggacatgtaccatggagaaaggggaccaaccacaccttctgtccaaactgagatttcccagcctgaaacaggtcaacactggggttagcaagaaactttaaactgaataggagattaaagtaataagaagatgagtactattattggtacaaattatattggtaatagttttaagtttcattctttaagacagggtgaatcacagtcccttctctcaaggtccttgtcagcattctacttttccaaggacattcaaaaatttctcatccaaagtcaaacattagtgtgtgtgcctcaaacaagaaatagttttccatcagtctccaaatctttgaatagtaaatggcaaaagtatggaaatgcaagatggagtggggcttaatgttgccacaacattcctacaatactgggatagtcttccttgggaattactttctttcctatcacgtatcaataaggaaagccaaatgtagaaataaagaaatctccccgatttacttaacacacggaggtgacagttacagcgcaaattgagggaagagtaaatgatttccacaaatgaaccaaaaacacttaaaagccacatttaagagaaatggagtcataaaggcaatatttgtgagcagataaaaaatcagcacagaaaaaggtgagaaatacacaatgtctttcatcaaggtgcaaggaaatgtaaaataacattaaaagtaccaactacataatttgaatataaagagaacaatagcaagaaaggagaggggaagtgatggcgatatggagacacagtctcttttgcatgcacagggcagaaccggtgcctcaggctggagggtgtctgtgagtaccccacaatgaaagcaaaagagcacccagcattgaagccacagaccttgctccatgaatcctagctgatgggctggcacagagagatcaggagcagaacaaggaaatccataggaggatcctcccaaagtacttttttttctggtccaaaaatccttaaatctgtcagaagcaggaggttggagtgggagaattgcagagcctggaacacacctgcctgctgatgacccattctgagggggttctttccacttggcagcaatggacttggtaaaaaaaataatagatccttctccatggatcccatttccctttttttttttttttttttttttgagatggagccccaggcagaattaaagaccaactctgggacccaaatttttagaggacaaaggttgatataatggccagcacgatttagtcatttagatttcaggtctaactaactgatgacagactttaacaaaatcactgaaagaaatttaacgtcaaccttaaataacagtagaggcaggtaatataacaaatagagtcaaaatggtttatctaaaggtctaagcccaagaaacatccaacaataaaattaatctaaaacaaattttttaataatcatttttttttcttgagacagagtttcgctcttgttgcccaggctggagtgccatggcacggtcttggctcactgcaccccctgcctcccgggttcaagtgatttcctgcctcagtctcccaagtagctgggattacaggcatgcgccaccacgcccagctaatttttttgtatttttagtagagatggggtttcaccatgttggtcaggctggcctcgaactcctgacctcaggtgatccacccaccttggtctcccaaagtgctgggattataggcgtgagacaccacacccggcctcatcttttctttaacattacaatttcccatcatggtggcacttgacagtagtgggactgtccaacagcaaatgaccccatctaagcactcaggacagaagccattttaggtcatgaaaattatacagattttgtgagtgaagggcatttagttctgagcagaaagtagtcttgcaaaagggaaatttgcaacaacaacaaaaaaggacaaggagggtgacaatgtcaagcaaatgataaccctgctggagcttcagaaggaaccagctacatccctttcctgcttctacagatgctatggcagccccagaggtgtcccactaggatctcccttcaagaaagaatctagcatgcatctgaacaacctccagctgttcacacctcaggccctgcctcatcccagacagccctgagccaatcactgacacagcagggtactagagcctggtcatttctgcccaacccggggcccctccaaaggcaagctctgctccagacctccccgttgggttggtcaaactatcaaatctgtacctggtctgaggctctccctgcccagtcttgcttcatcctcattttatccttcacaggcacagcccccttccccctccaataaaacactaacattcctaattccgtctcaacatctgcttcccagggaacctaactaacacaatactcctaaaaccaataccagcaaaaagtgactttccaagcccctacatgaagactcattttctggaaaataaaatttaatataattccaattacccatgacgctatttagccatttcaaaggaaatgagaaagcttcccaaattgtggtcctcatggagtgaactgatcatcaaatgttgctgtttacatgagggcacacaataattagggttgtatgtaacatgctactttcagattttcaggtaagtctaaatgcttttaattgatgcaagaataataagtccttcagttgatttatgtcatgcattaatatcaatcaaaaggttttctaacacatactttttaatactataaaatgtggggttttttttaatgtcttttttttcttattcagagccacatttcttcacatggtatgttttacctaacctaagggttatgttgttcgtttgtttttaatttcaggtttgaggaatcaagtaacaggtctttctaaatccttttattggatatatgttagttttccattatcataaaagactgaggaacaggaacagcagcatattgtttaaatgattcacaggtaaaaatatcttctccctcttggtctgttttctttcctgatgtctttgctcattgccaacattgtctattttatatataattcttgcaggacattgtgccctgaaggtgaaattggacaggtaaggagatgacccaacaccccttgtcacacctgcaggctctaggtcacttttgtaacacacaatgaaatgggtaaattctacacaatcctttttttttttttttcaaacaataacagaaagtaaatatttgaactgggggctttttcaaacaacacaagtcagaaaaaattgacttgtttttgactgttactttaggcatatatttttgattaatgacaattaaatgtaaatataaagatattttaaacttgaggttttaaaacaaagaatgcaagaatcacctggttaaagttagatattttgtcagtctcaaagtcagttggctggataataccatatcataaaattttataagactaatttgaaggtccatatgaattggtattattgttcgtttttcaatattgatcttagcagtgtatttacagcatacagcagagttaatgtttaatacaaacaaacaagactttccagaaaatctacaaagaatcactaactaatagccatgcttcagttaaatttgtttactttttaaagtacattctcagaagtaacatgtactctcaattaagtaaaacacaaccagaattttggaatttgatctttaaaataataaaaaaactttctctgctatttacagccttggttaaaatcccaacatctggataccagaatctgagcagcaaaatccacggagacacatgtgcaattttatgcctgcaagctcactattatttagaacgaaaccaacgtagtgcatctacccttgtttcttgctacacagaatgtatccagagtacaaactaatgtagattattataaaactcagtgtgtagatattatatatatatacacatgcatacatacacgcacatatataactaaaacaaaatcttcaaaaataatactttttctttctgtatgtgatgtgccctgatagtttccactttactccatcccatttccttttgttaatactggccttgactcacttagacaaatgggtcatgacctgtagtttggaaaacagggctttccagcctggctttaaagaggctggtcctcaggccagcagaaccagcagcacctgggggtagtttgtggcgcacaatctcaaggcctgccctagacctactgaactaggatctgctcttagcaaggtccccaggtgacttatggatgtattaaagtttgagaagccgtcctcctgcatgcaaaagtacagaatgagtatctgtgatctgaactacatttaaatcgataatgcacctcttaaactgtctttgttcaaagaacttctatcctactgagctcaaggagcaacacagtttctagcaagataggtgcaaagaaaaattcactttcaatttcatcaactgcttcaagaggttgcagggactggctgacctggtatcccagctcctgcaggaccgagagtgtgggaggtgggttgaggggaggtactgaattgactgcaatagatccatgagcatataaaagtgtgcgtgtttgttcttattcctgggagaaaatatatagtattcacctaattttaaaagagttttatggtttaaaaagttaagaagagctactaagccatgaaaagacgaggaggaagcttaaatgcacattactataccagataagaaaatctgaaaaggctacatagtgtatgattccaaccatatgacagtctggaaatggcaaaactatggagatgtaaaaagatcagtggttgtcagggcctaggaggtcgggagggatgaacagacacagctcagtgaatttgaggggcagtgaaactaatctgtatgatattataatggtggatccgtgtcatcacctgtttgtccaaacccacagaacatataacaccaagggtatacggtgtttatattaaagtataaccctaatgagaactctggactttgggtgataatgatgtgttgatgtaggttcagcccttgttacacgtcagccacccatgtgggaaaatgttgatagtggtggaagctatgtatgtataggggcaggaattatatgagaacacttgtggtatatgctcaagtctgttgtgaacctaaaactgctctaaaaaataaagtctgtaggtatctatgaaagcgcagacacatggtccgtgagagcacgtcctctctgctataaattggttgtatggttacaatcatacctagaaaggagagaaaataaagagtaagtgaataccgacatgttcaattctgccccagaatacaacaaagtccctgaatcactcttgtttcattgttgccattgcttattcaattcagtcaactcgtatatgtgaagcatgtgctacatacataacgtataatgcaggatgcaaaaatgattatgtgatcacttcaagtaatttataatctagcaaacatataaaacaggcacacagataatccttacatagtaaatgcctcctttttccccaaaatggcaaggagacaaatagcaaggatccgaggacagagaggcaaaattcagaaggccagaaaggcatggagccagaaatccaattcactcgcgagtaaggtatcgggagagagtggtgtacaacgtgacagggacacctgttgctcccaattgtaatcttttctgattggtttatgcccctttccaattactgtgtccatgctaattatcaactatttttattatcaaccctgcagaggggactaagagaaaaaaaaaaactgctgcaaagtgatgctgtgttcattttgcacagaacccagaaatcctgatgaaggaaactgaattggatgccacaagccttatctcctgtgaatgctgaatgactttgtcggtgggttttacgataagatgtactttcttttatatctattaaacaagctatacagaatactggtaaatacacagaagtaaaaagaagaataaaatagataaaattttctaagttaaaagctaagggaaaaataaaaagaattatcaattgatgtgatcaaagaaaaatgtttatctcatggggtgttggaaaaggaacatcataaaaattaataggtagaataatcatcaaaaacaatctgcacaacaaatattacatagctgaggggaactatcattaaaatataatgtatacaaattgctgagaaactcactacaccttctaaatcatgtcaaaagagttgtttgcatataagctgtctgcacttcttctctctctctctttttttttgttcatattcactgcaaggtggcttttgtccacccatgcaaatcactcatatgaaggtcacaatgatgtccaggtggccaaagcctgtggctaatcctcagtcctcatctcaccgagacagcagtttcttagcccttctcctacctccactggcttctcttctcagctcctctgtagttccccctcctctttccaacctgtatgcattggaggggcccaaagctcaaccctaatgctcttctgcatcttggtccctaggtgatctcacctagtcacccagcctcagatagccttaggcttaggaatcacaaatatatctctcacatgacctctagactcatatcaacctctcaacatcacaatttggatatccaacaggcatctccaactcaacacagccaaaccccacttttgacttcctgctcattgcaactgtcccctcttgcagatgtcccttttagagtaggtggcaccatcatatacccagttacaaacaaaatctttaaagtcatccttgactctcctacactgcatatctaatccatcagcaaatgctgtcttttccaccttcaaagtagatccccagtctgatcatttctcactacctcccctttcgctgcctggtgcctggcaatggcctcctaattggtcttccctgtttcaactcttggtccccctctagactgttccccacacaacagccaacatggttcttttagaacttcaaccaatgtaaattatacttcaagaaagctttaaaaaattcaatcagatcacatctgctatgaaccttccaatggttctcctcccgcagtgtgccaaataaaatggaaatgcccttatccttgcttaacagaagtctacaacacagcctcaccagcatgcctccaactcacatcctgcagctttaacctcactccacgccagcccccagtctccttgccgttacttgaaagtgccaggagagctcctgccaaagggcctttgcacatgctgttccctctctctgcaatactcttccccgtgtgatcatacggctcatgctcccactcccttcgggtctcagcttgaatgtcacctcctccctatgaccttccctaacctttcgtgtaaaattctacctctcccttcctcagtctcttgcttctcctgctttgttctggagaataccaaccagcaccacctgatttgtaactattcccttgagcacattctatctcagccacgggaatggaagcttcatgcaggcggggacatcatctgttcagttcatgctgtagcccagcaattctgaatgattagattgaaattggatccaaaaatatcacaaatgagataacgtaacttgttgataagtgtgtgaagagtatgaagagatgatcaagctcacaagtttccaagtgctaacatctataaaactccattgtcacccatcaaatcagcaaagattaaaaaccacaatagaatgtgataaaatagtgctctcagatacttcctggagaagtatagatgggcagaattgggtgatctggtatcaatgatcattctttcataccaatacaccatgggattttgcgatcagaaggtaaagaagacacagaaggaaaagaaggtgaagattaaaccagcaaaaacccataataagtaggacttcttcctattcattagtaagaaagagttgggtgtccccatgggaaaatgctaatttagtgtcctgaaccactgtaccctccaattcctgcttcccccacaacagtggccccacactgagtcctacaacgaggataatgatcctcaacccccaattgcacagacagggctaagtcagagacagtgatgccaaccttgctgatgtctctaaaacactcaactactgggggctaaccctaagcaaaattattgactccgattcctaagttaatttcctataaggtggaagaagcaacaagtgtcacttctcttctgggctctatgacaccaaatagtggagccgaagagacttgctgatgttttgaaacccaaggccaaataatgctctctaaacccttagaggtgtgactaggatattcacagaagccacgcaaaagacagcagccttcaatgaagaaacaaagaaacaaaaaacatggttccttttataaatatttatcgattatctaaggctaggttaattgttgataactatcaattatctgagcaagatacgcagaaacacttcaggtgcttgaactgcagcatcctgggctccaacccaaacttactggagaagaagctttagataccaggaatctgcattttaaccaactcctcagggaaactgccccagagggggtctaggctaaccatgcgcaacttccacccattctcctgggaagtgattgtgaatctcctccaaacccctcttacacttcctgattaagttggtgccccctactgaatgtcagcctcactgaatcttaacgaggaatcgccagactgggggggggattgtgcagcatgtctggggaacacttcactacttcactaaaccctgctgcacacatgctgaacaccgttccaaaggctacaggaactgagcaccgcattggaatctggccctggagggtgcccagcatggcgaccctgaggggtgcaggaacccagtgagaaggagaaacagaaggtacagtccagctcgagaccacgcacataaagaaatctgtaggcagggtctctattattgtgccatattaaatatcttgatattttaaagcaatattatttttctgattataaaagtactcattgtagaaattttaattgtgccatcatcctgcagaaaaatgaaagtacaaaaaacgaaaaagcagctatacacggccacaaagtcacagggctcatcgggatgtgctaaccaggctggaaactgatcaaagctgatttattgagaaaaaataggcagcatatcaaagacttacatcagcttcatagtagacagactttgggggcgggggaactctgtctcttttgagtatattctcaaaaggataaactttcaccttcctgtgaagcacagttactataaatcagatttgcaaactgtgagaaatgcttacaactcaatgagtcttttgtcagccagtgggggctccatcgtgaaatccacccttcgccatagcgatgggataaatcatcaccagccccgagacatcgcctaatcccttcctcgcaaggcagattcgggcgctttctgcatctgcttcgtgttattgaaaagagctcggctcatctgctgggctctcaggcttcacagtgacctcgcacagaacgctgctacttctgaaactgttttagactcttccgtctatgaaacagacacagagtttaagtttagcgtcttttatggtcagaaatatttagcgttacttccagagcggcagccgtggaacaatgtgggaaagaagtgcttcagttcacttcttgggaagtactgaccctgggtcaatttaattttttccgtaagatttccccttcttacttttctccttccactgctatatgtaacagtatctccccttccactgctatatgtaacagtatctccccttccactgctatatgcaccagtatgctagtatacaacattatagattaataatatgctatattgtttaaaaatattaatgttatataattaacatggtgtgcatattattatattgacaatacgtaatgtgatgtgataataagtctcactgagtgccaggcaccgctttgaatgctctaaactcattagctaatttattcctcgtgattctatggggtagatgcactatttcattcccattttacagctgaggaaactgaggcagctagtaacaggtggagccaagcttcacactgagatcatctggccccagcacactcataaaaatgagcaaaagtataaaagccaaagggaaaaggaagccaaggggtgaaaatcctaattacaaacaaatcctgggtaagctgggtttttagtccttccccacatgtgaacagcaactagaaacctgaacagtgactttgtttcccctgtcatccattgttggtgcctgatcctcacacaaaatcttacggagcagtatctagtgattagcttagctgaattgagcctggacacccttcatgagctggaggacagaggacgtgtcgatggagggtccaacttcaggcatctgtactcgcctgctacaggtgagtggacctatgaacccccagcctcatcaagcacccgagggtcacctgcctgcttcacctggaagagacagcaaggtgtgatcccaggaagatcctctgccaggaggcttacaggcagaagcagcggctgctgaacatagatgctgtcggcaggacacaggggtgatagggggtgagccagtggagcaggtgaaggtgcagactacaggcagcccccctgagatcctgcccagaccccagcagcagctcccctgtccctctctagcagcttcgctgtgcccgaagtgtttgagaacaggtgacccatgccctgagtggcagatgctgtgtctttttgatcccttctctccctccccccccacccccagtggggtacatggaaggtttgctaaatgtttgttgaatgaataaacgagcccaagtcagaagcagtctccaaatcattcctcatcgcaaaagggtgcggtggaaaaactcacaaagccaaggcaggaggacacactcaacttggaaacggcccgtgcccagctttggaacaggcacagcctgagcttcaaggaagtcacttgaccagcagtagctcccacctttccttgcagctagaacagcatcagaccaagtgatctctaatgtgatgatttgctaaagtacaatgagttttacaactagaaagtaccttcctctcaagactgacttcactatgagccacctaatttttcctctctcttcttttggtatttttgttgcaaatagtacacacaaaacaggatatataatctatttgtgcaatttaaagaataagaagcaaacacctttgcaggtactccctagtccacaacagtcagccccaggacctcagaagccccttatgcctttcccctaaaactctcccctccctgacaaggtaattccaatgctgagttatgtggttttttttccttatttttcttttcaacacatattacgtttctctgaataatatgctttttaatgttgcctctttttaatctttatttgtggaatcatattgtatgtaatctgtgacttttttctactcacatatgagaaccatccacactgatacatggctacagatagacacttggagtttatttttcactgctgtatagtactccattggtggagtacaataggtttatgtatccacttttctgtagatggacacttgggttgttctgtttttgctcatacatacctcctggtgctcaggtacaagggaatacagacccagggtgagactgctggatcacaggctaggcacatcttcagctttactaggtaacaccaagccaatacaaaagtgcttgtacaaactcatgctcctgccagcatggaggacccactgtgccacataaaaacatcactgttattaacttgttttatttgcatatgattattttttcccttatccccaaccacttctcaaagcaactagccagcatgtgccacacaggcaagcacccactccaatgtgatctatatggttaggtatgtatgtaccctggaaaaccctgtgatgttgcttgaggagtatataacttttttatgtatgtaagtagcatgtgctacaaagcgcgttctgttttctgtatttttcactccactcagtgttttgtaaaacatgctcatgttgctccataggtatcagagacaggatgatgttttatctttaagatgggtacgccaccctcattttatagatcacagtgatagctcacaattgtttagtactcagtggggtctaaatgtactaactcgtttaatctcccacgaaccctgcaaaacagatgcttccgtttcatataaaatgagaccaaggcacaaagaaactaaggaacttgtacaaaatcaccaagttagtaaacatcagagcaggatttgaattgagccagaatgtgttcttatccacgacatgaaactggataagaatgcaaagctcagagaattttcatgactagcatctctgggattcacagctggcgaccacggagcagaactaatatacagatggttcccctctcagtccagtcctcattccatcggctccaaaatgtgtattattctatatgattagctggtgaacaacaaaggcaattagttagtcctcttcagcaaatgttagtaaatgaaaatattatagagacagaactctttttaggaaatgcaatcatgtgaatttaaaaatgctttatcagaaatagaattaatgacaaaaatatttataggatcctaagaaaatggatttgctattttttttgtcggctgatgataatcatctgggtgcatctttggttgtgacagctccaccccttcagagagttgtatcttcatacacacctaacatgctaagagtagatgtgcatgatatggtagttagtataatttctgtaataaaaaaagtacttggtcatgcctgtaatcccagcattttgggaggctgaggtgggaggattgcttgagcccagagtttgagaccagcctgggcaagatagtgagaccttgtctctacaaaaaaaataaaaattagctgggtgtagcggtgcacacctgtagtcccagctactcaggaggttgaggcaggaagatcgcttgagcctgggaggcagaggctgcagtgagccataatcataccactgcactccagcctgggcaacagagcaagactatgtcttaaaaaaaataaataaaaataaataataaataaaaaatttttaaaaaaggtacctggaacggcctgcaaagaaagggaaatcaaattatgcttcaagacagtcactattatcactgacagagaagcagctaaaataaacagcctgctcattttgtttgtaaatgaattgccacaattcttgcactatttaaatcaagaatattttatattccatagttttcaaccacccctcctttttttattgtttccagctccttaaacatataaaaggataaaagccatttgttctggcagaaaagagtcatcataaattttgcagagtgaatttctctaagatgaaaggaatgttcctctcctccaggacagcctacggacaggactgtgatgacacagagtcttcacgggaatcacacctgcagtgttaagccacttctgtggaaaactcaagtccttctcagataacaaaaacattttagtagcaatgaaccaaaaacaaaatcttccactatatatgttaatacatcaaaaggaaccattcatgtgccatttataagaacttccttccggccaggtgcggtggctcacgcctgtaatcccagcactttgggaggccaaggcaggtggatcacgaggtcaggagattgagaccatcctggctaacacggtgaaaccccgtctctactaaaaaaaaaaaaaaaaatgcaaaaaattagccaggcgtggtggcaggtgcctgtagtcccagctactcaggaggctgaggcaggagaatggcgggaacccaggaggcagaggttgcagcaagccaagatcgcgccactgcactccagcctgggcaacaaagcgagactccatcaaaaaaaaaaaaaaaaaaaaagaacttccttcccagaaatcatagcagcgttcctcagcccaaagccagaagaaacttctcgcacatgaaattttacttcaaaaactcccatatcaggcattttaatgaatcagtggaagaaaattatcctcccaactttgttgtcaagaaccccaatttcatatgcagaaaaaagaattacaaaaataattattcgaattctaattggtgggattttgataggtttataaaggaaataaatatctttaacacaattctacctcgcagccaacatcagctattagcaaccacacttcttattgccagttcatctctccaaacacacagaagccatgtgagttgaaatttattttttaaaaactctcagttatgatttctcaaaattatatttcatatattgacatcaaccaatatgatgatgatattatatattgacattaaccaatacgatcaaccaatatgatgataattgtagggaaaagaaagagagatctgactgttactgtgtctatgtagaaaggaaagacataagagactccattttgaaaaagacctgtactttaaacaattgctttgctgagatgttgttaatttgtagctttgccccaaccactttgccctagccactttgacccaacctggagctcacaaaaacatgtgttgtataaaatcaatgtgtaagggatctagggctgtgcaggacgtgccttgttaacatgtttacaagcagtatacttggtaaaagtcatcgccattctctagcctcaataaaccaggggcacaatgcactgcggaaagccgcagggacctctgcccttgaaagcggggtattgtccaaggtttctcccatgtgatagtctgaaatatggcctcgtgggatgagaaagacctgactgtcccccagcccgacacccgtaaagggtctgtgctgaggtggattagtaaaagaggaaagcctcttgcagttgagatagaggaaggccactgtctcctgtctgcccctgggaactgaatgtctcagtataaaacccaattgtacatttgttcaattctgagatgagagaaaaaccgccctatggtggaaggtgagacatgtttacagcaatgctgctttgttattctttactccgctgagatgtttgggtggagagaaacatacatctggcctatgtgcacatccaggcatagtaccttcccttgaacttaattatgacatagattcttttgctcacatgttttttgctgaccttctccttattatcaccctgctctcctactacattcctttttgctaaaataatgaaaataataatcaattaaaactgagggaactcagaggccggtgccggtgcaggtccttggtatgctgagcgccggtcccctgagcccactgttgtttctctatactttgtctctgtgtcttatttcttttctcagtctctcgtcccacctgactagaaatacccacagttgtggaggggaaggtcaccccttcagataataagataaatcagagccgaaaacatagttcattcctgaaatcaaatatagaacgtttctaccaacacacattttcaaagatggtgttttcaggtttgtatgggattgtttcacctttatgaattagctttttaaaacctgtaatactttcttgctgacttcatcatttccttctggttgcctggaggggtggtgtggaatgctaataaaatgaatttcagttgccgtccctcacaatctgaactatagaagatatttattgtctcaacttccctatgagcttttctttgcatcatgcagcttcatggtcagcagacactaaaaattaaagaaagtctttctcccactttacttgtgtagcacagacacactgatcaaatatgttcccagcacttccgaagaaaccttatcacatccacaagagatttcctacttgcactttttttgataaacacaaccatcatagcccaacaaaacatcacacagaaatcaaattatagtgtccccataagcatctgctcctctatggccttgggcaaaatttagaatcctcgacatccctagagttaccacaatctctgaaagtgaaggagcacccacaaagctcaaggaatgcattgaaactcttattacttccaattccattttcaaaaaaagtaaatgtgtgtgtatgtgagctgcacatggtccagaatgcctcaccaaatgtattgttttaaaatgtgtgtacgtccatgtgtaattgtatgtgtgggattttgaaaggctttttatattttattcaaaaaggtacacttttcaatatcacaaactttgctttcaattataagcccttcccattttcaattaatgttttaggcaaggaatatacattagtaaaaccaaccacaccacttagggaaaatgaattagtatggggaaagtgaagaactggccatgcagtcaattactttggccagcatagatatagttgaactaaccagcacaggtgtagacagcctgtttggataaggtagcttaagccccaattttttctgcagtctttatttttgtcaaatatatgaaaactaccatctcatttcctccctgtagctattacccacatgtatgtgtagtgtcaaaataaatggccagagtcctctcagggacctcccttggcacaagtcgcacttcctcaccctctcacctccagagcctcaggaagtgcaggtcagaaagcagccagggcaggtgtgaggtgatggagcgctgagtgtcggcgagcccagataaaacaacgttccaacatcggaaatccaatcattcacctacttgtctcctgctcgctaaccccaggcaagtataaaggagatggaattataacaggagttagaagaatttggatgtgatttcatatattaactcagcaaaattttttctgaaaaggtccagacagtaaatattttcagctggcaggccatatggtctttgtcgaacctactcaactgtgccattatggagtgaaggcagccacagatgatatagaaatgaatgcatggggctgtgttccaataaagctttctttatggacactgaaatgtaaatttcatgcaatttacatgtgttacgaaatatgcttcttttgatttttcaaccatttaaaaaagtaaaaaccattttcttagctcctgggctgtgttgactgacccctaattaactgatatgtgggctgctatccatgaaaacctaggcacagaggaaggcagagctggcttcccagccaagacgggacttaccttgatatgagctgctgggtccgggacagtctgaatcatgtccttcagtaagccagcccatctaccagctgttcagaacctgacggctagaagacaaaaggaacaacatacataataataaacaactgcatttctgtgttttatgttctagcaggacaggacacaattcaccaatggcaaaagaatcatagctttacattaaacatgtttgcctaaaggcatcctctaggtacgtgtggtccatgaggtgactagataactcacttcccttccattgggaaaatcacttacaatgagcccaagagaaccctagtccgacaggacagaagaatctagctcaagctaacccacatcacatgcagcatccacacatccttccacgtgggcagcatctaatgagggatccattaaaggaagacgtgggactaaaacagggcatacttctctatcatactgagaaaacaggactttgaaatcccaccaaaactcatgcgatctgcacatccttttcagctttgttattaagttcttagtaaacagcacagctaccattcattgagtacttcagcgccagttccttgagcgctaagggctccacacacattttctcatttcattccaaccacgactctgagagctgtcattcccattgtccagctgtggacgtcaagactcataaaggttactgatttgtccaggatcacctggttaataagcgacagaaccaaacttcaaatcagattaggctatctgactccagagcccaaaaaaaatttggtttgacttaattagcaggtatcaacccacattttgaagggacattttaaaacaccgcttaaataaattaaatttaaagatgcctataatccaggaattttccagaaataaatacttcatccaatatattcctttattcaaattataaagcagcatgttctgaccactgtctgtgccctccccttccaccgagccagtctccaacctccctttgctgtcacaggccccagggctgacctctacagatgggctcagcagggtgccttgcctcctggccacctgtcagggttggttgacgtggccccctctggagagcaggggtgagaggagaggggtatctcttcccctcaccttcccaccaccgacacctgccgcccaacctccctgggcgcttggttatggttctgactgcagctggattctagggggacctctcccgtcatggggcccctccttccaggctccagcctccagtacctggtccccagccagtctctggtgctctgcagatctcagccaagccatcagttcttttttggcactaaaaatgccttttttagtttacatttttagaagccatcacttgctttttatcacctgtagttttttgtttgttttctcctttacaatggctctttgcagtaacaaatgcaaaataaaaataaacaatatgattacagaacttgagacattttcgaaggctgtctttcaaatttgctactgagcgcattactgtagtgacaagtgaaagcattcacaggagtcctccccacattcacatctgtcctttctgacctctcacggtacaggcacacccattccaacccaattgcctctcatgaagagcatctacctccagatctgcatgctccacatctgtcttcagtctccctggaggcctcccaagattggcggagcttggctcaccaagaagatgacatgctgggaaccttaggcattttttttctataaccaaatttctaggtcttggaaaatatgtacttccccccacccccacccccaggcctaaagtccctctgggggatgagagttactgaaagtacagagggagtgaagtgcagtcctgaaattgaaccgggaagcagatgaaggtgaccaggctcctggtgctctcgtgggagaagaggctgggagaggatggggcctggctgaaggtttctgggagcataggaatcctcaactccccttatcctaagagcagcaggtgccacaggaaaacaccactctgctcctggggtcattcagcccggaaggggagcgtctgcaagccatcctcacaaagggagggcgtcccactgcacaaccctgctctggggagcacatggctatttccgtatgtctggacattctctctggactagttcactccgcacagttcctccctgcctgcacacacatgctgacgctcacaccagggactgaagctcgtccccctcccctcaaacccaggctgacctgtggctgcctctgacctgcagaacacagcagagggaaggtttcaggagtcccaggctcaggcctttatggaagtgggagcttccccttcctgcctcctgaaaccaagtccccataccctcagcagcacagcacatggcagaggaccgagtgcccagtggggcagccagcaccaacgccaggcccgggagggagttgtcctggacagtccagagaactgactctcagatgaccacggcccctgccgacatcagggaggcagcttccagctgagtccagtcagcccacagaatcatgaccaataataaatgggttgttgtactaagctgctaggatttggggtagtttattacacacacaggtcattgaaacaccctgtaagtgctctagaggcacggagaagatagagggtaaatagcttgtttcactgtcactatggataagtacaaagatggttccaacactcaactcctcctgtacccatgctttttgccacataactttgtgattcttcccattaaagaggtagaattacttcccaacccttatttttgggcggcctatatgatctgcttcagccaacaggcagtagcagaaagacaagtatgacagatcctagctgaagcctcaggaggcaggacatgttcccctttgcttttctgtaactttccaccagcatgggaacatggccagatgcatgcgggaggatgagaggtacctgaggcagagtcacccaccccaatcaccccaccaagactacgtttgatcatcccatagacaaccaaaaccccagacatgggagggaggcaaccagaccagccgctagccaagtccaaccagaatggccaacccacaggctcatggctgaataagtgcttactgcttgaagccactgaaatttggggaatttgttacacagcatttttgtgacaatagattactgacatacactttgcaatgtacaatcagattaccgagatcttcgttaaaatttttctagccagtgataaaaggagactcaaacagggcatttcaaaggaagccacttcatcccaacacagagacataatatttccactcacctacgagacatgatctcaaaccctaatcctgccctcaaaatgggtttggaaactgaaggataaccaagaaacctccaccagaagcctccatgggattcccagagcccttcccaggagcaactgaattctcacttcacatgatgccctgccagcctcccctggattccaaaaatcaaaacatccttggatatccaagaccgcagcaacatcatagaagttacagcagccactcggtctgtaaccaaccaagacataaactaaatgagcaactgtttgagtctcttgtttcttatggggaagttttgagtactcaggttgcatcaagtataaaatgacagggaagggaatagatagagattccagatgcaacacagtcctgatccttgagggatcgagatgggaaacagatctgtttcatacagatatgaagcggtcagtcctgagagcaggcagttagtggaggtgcccagtgaggcgtgtggatatacctagaggaaagagagagctgattcatgcagagacaagagggtgccaccaaggagccttgatgaacaagaagcatgaggactggaggaaagagggtgaaaggcatgaagcagggaacctaagtttctcccagctctgccacattagagaccaagggcgtatgagcttctcacaccgccaccaccagagtgatcacacaccaaagggattcactcagcacgcagcgtgatggcactgccaccctccacaccagctcagcgaaaacccaacggacctaaagaccaggagaataaaagctcaaccaccctcccctgcctcctcaacccacacggatctctgactctttttttttttttgagacggagtctctctctgttgcccaggctggagtgcagtggtacgatctcggctcactgcaacctctgcctcccgggttcacaccattctcctgcctcagcctcccaagtagctgggactacagccgcccaccaccacgcctggctaattttttgtatttttagtagagacgggatttcaccgtgttagccaggatggtatcgatctcctgacctcttgatccacccgcctcggcctcccaaagcactgggattacaggcgtgagccaccacgcccggctaattttttgtatttttagtagagacggggtttcaccgtgtcggccagatggtctcgatctcctgacctcgtgatccacccacgttggcctcccaaagtgctgggattacaggcgtgagccaccacacctggccctctctgactctttttgcagccatttgagtgcctgttcttttttaccatttcagaggtattttatggattttttaaagagtacttctaatttacttttgtgttcctaatggtcatttctcaaatatgtagtagttggtaaccaaacaaactaaaaccatactaaaaatttttagtagttggtgatagtttcatgtcactgtaggaacctttttattttctattttacctgcctttgaacccttgcagaacttcactctatgttgattgaaaatcatttctttaatacttgtttcttgcaataaactcatttgctaaggtatatacttccatatgattttgtgtttcatgacccagctatattttattattgggtatcttaaagaaacaaaaaaggccttaacaataacagaattctacttgtgtcacttctttgtttttgttttcaaaatgccaatgtcttactaaatagaaacaaacttgatttgaattacgtaagctctaaccacataaaaaagatggactggtacccaaggtagaagggaaaataagcattttgtaattatggaggcagtattgcaaaatggttaagagaaggcctaaatatttgcagggctggtgcaagaaaatagatggaagtttgagacccctcgaccctacccctcctctcttctcaaacccaattgtgttctgcgggttaggggatgcatatagtcacgtggacatcccgatccacatggccacactccattcagcaatgctccctgctcatctttcagacccagggaaacacacacaagatcttcccaagaagatgaactccaggaaacaggctggtgcagcccaaaagatgctcagtcaagtttggaaaggcactctgggtgccccagcacctggggcatgtcctggaatggggatgggttcagctggggagggcaggaatggggcctagaaggcataggcaggacgctgggctgggggcagtgctcgatatgagcacagtgcagagccagatgagggatggaaatcagatctgccacttactccttggaaacctataaatgatcactttatcctccaagagccttagttacacatttgcacaatgaggataatattactgtagtataataagaactccatttgcccttgtctctcgtttctggcatggagctcctaaaactctgggaatttcccaagtgatgggagcatcttttgttctaagaaggcagcaggttggtgagtccctagatagcttcaggatgggggctaattgcaagaaagagtgagtcttgattagatgctcagaaccttcagccccatttcccaacctctcaggagaggagaggagctagaaattgagttgatccccagtggccagtgatttaatcaatcctgcctatgtaacaaaatctccataaaataccctgacggggttaggacagcttctgggctggtgagcatattggtatgaagagtgtggtgcaacccaatgctaaagggacagaggcggccaggcgcggtggctcacgcctgtaatcccagcaccttgggaggccgaggagggtggatcacgaggtcaggagatcgagaccatcctggttaacacggtgaaaccccatctctactgaaaatacaaaagattagccgggcgtggtggtggacgcctgtagtcccagctgctcaggaggctgaggcaggagaatggcgtgaacccgggaggaggaggttgcagtgagccgagatcgtgccactgcactccagcctgggcaacagagcgagactccatctcacaaaaaaaaaaaaaaaaaaaaaagggcagaggctcctgtacttggaatccttccagaccttgccctgtgcacctcttcatctggttgttcattcatatgcttaataataaactgtaatcataagagcatagcgttttcctgagttctagcaagttgttgcacctaaaaggggggttgtgggaacccccaatgttgtagccatgtcagacagagtgtaggtaacctggggacccaatacttgtaactggcatctgaagtgaggacggtgttggggagctcagcccttaaacccatgtgctaacttccggtagtcagtgtcagaactgaattgaactgttggacacccagttggtatcagtgttgaatgactggttggtactggcgaagacatgatgtatttggtgttgggaaacatgaataaaaaatttgtaaaacctccaaacgatgttcagcaattcacaaaggtgtcagtgcaagagttggcctgtatctattctaactggtcagtatgcaagttgaaccattgtttgattatctcctctgtctacaccatcaggcttttgtgaggattaaactaaattatgcctcagaaagaaaactctctcaaggctaggcacataatcaacactaaacaagtggtaatcattataattaagaaagtaaaaatatttcaaatggacgattttgatactgtataaaatgttgcaacttttttttttttgagacggagtcttgctctgtcgcccaggctggagcgcagtggcgcaatcttggctcactgcaacctccacctcccgggttccactgattctcctgcctcagcctcccgagcagctgggattacaggcacgtgctaccatggctggctaattaaaatgttgcaactttttaggaaaaataatcctcaataaataaattgctaattttcataagagccctttgtcaactgactaaaaacatccttaatttagaaatgtattttttagttttaagataactagtcattaagtgaaaacattgtaggcaaaatggctctaagcaatttagtattcataggaatgaatccattccttgaaagcattggtcgctgggtgcacttgtcctggatgagcagatattaggcaaatcagtctttcaccagcaaaccctgccataagaactgcacaggcctgattcctgccaagcacaccaggcccctgactggggcagaggcctcccttatggggcaggaagaaggaggcagggagaaacatagggcccatgatttaaggaggctctccctctcaggctcatgcaagtgcaggatcagtacctaaaggggagcaccgcccgaaatcctgtgccccagtcaccttaacccagtccagccctggctcctgcactccaaagctaagcagggaataccagcgggagacagaagacagcatgagaaactgaatgcatctcccacatttatctaaaaataagaaaatggacttcttcagtaggaaatggctcatctttccaaatgaataaaaatacttatagctatgggttgaattgtatcaattctctcccccagttcatgcactggagtactaacccccggtccctcgggatgtgatgatagagaggtagggcctttacagaggcaatcaaattaaagtgaggtcattagtgacctaacccaatgtgactgatccacttacaaaaaaagggacaagatttaaagacagacctgtatagaaggacgatggtgtgaagacacagggaaaagacaaaagaggcctggaacagattttcctcaaagccctcagagggaaccacttgggctgacaccttgatcttggacatccagcctccggaacggtgagatgatgaatttctgttgttttaagctacccagttcatggcagtttgttacaacagcactgggaaaggaaatcacctctatggagggacttacgaaagtcacttaactaatgcagattagaggcctcacagtcagggcatggcctcaagagccacatccattttaattgtaccatttctcactgaactctgaccctggtcaaggcatgtctcaggctccatggactactattccttccactgatcgaccctggcttcattctggcaagggagggactcatacattctgcggcctgcatgagtgtcatgtgagcacccccataaccttgatccctgcggtgcttctccaggggagccctagcattccagctggcctcatgggcatgccttagagagagggagctgaccctctccttcttcaactggattttatttttattttttggcatgttttgtgaatacaaagattcactgcctgggtgtgccccttgaaagaaggtttcaattgcattcaggtgaaataaccacaaaatgactgtaagccaaatgtagtagtatgatagaaaaatggaaatatcgtaaaagcaccagtctgtagacacctagcttctggttcctctggaaaagggagaagagagtagacagtgatggagaaaagaggggctgtgaagactatagaactgagaaggcagtaattctaaaatctccacactgtagggccaggaacaggcagtgctgggcaatggggcatcttatctcagggaagtcaagggtgtcatgtagaaccaacataattcatccaagtacagcaaagaatccagaaatggtctgtggaggtttggaaccatgaaaatcaaataggaaagatacaaaatatttacatatccacattttttaaaaggggtcctgactaggcagcataagattatttgggttctgttcattttacctttagttgcccttggttctgccatcttttttctctgtgagtcatttgtcttgcttttggtcaacacggctttcctcgggtctccaaagatcctggaataac

SEQ ID NO: 1009 - DNA, 67143 bp, Homo sapiens
gtaatgccaagaactttatatctttaatagtgtagaaaattgatgacacccatttccttgagaagagggtcaccctctggatacaaactaataccacacagagtttctggatttcattctcctcaaaatctctctgccccagtccacagtgggtgcgagtttcttgcctctctctcagctgccactcttctgctgaggcagagaagttttctcatcctctgggtctccactataaccccaacttgcatgccccaaagacacgcacacccttcccaaaaacccagcagttctctgtgagtctggtagaaagtccccattatttgtggacctactcagccttggtgagtggctggtcccaacaggatccacaagaaacttgcatgaccgcaaggcctgggcacaagacaaacccttccactgccatgctgccattatggctgttgtttttccatatggtctcacatggcctctcagcaggggacgacactgatgggatttttatgggtctgtaaataaagctctttctttcccactggagttgtaaactgagaagtagacacaagaatcagacagatggagatcaaaacgtcagctttgctgctgatcagaaggaggtggctggatgtggtttatgccttcaggttgatgggcttgcgcttatctgcttgtcccttctcccatctgatttcttgtggagcccatggaggtaaagttggtatttccaaatcagacattttgcccaaaattgctgcccctctctggttctgagtggaaagggaagaaaagaaatcaaatctcagttacttatagttttccagtagatcagcctcaccaatcatgggccatgagccaatataatctcccacagactgagacctccatcccccatggtgaggggctagtgagactggaatacgaagagagttgctcaagtggcattccctcctcatgtaattatgaggcacagggaagaagagggccctgcctttttgctccctgaatgcttaacctttagattgaagtgttaagtccctggttggccagggaggcaccatcttgctcttgcggctgctcacttggcaaaagctgcccctgccttcagccacccactccccaatatcagccactgtgtcttgagtgtcttccggggactactgccagggagtatgtattttgttctcagaagctgtcacttgggtcagaatagtaaaatattcaaattaagtttgagccacactgaagtcaaagttggaaatttattttttctttctttctttgcattcttttccaacaatattgcccaatgtagcttatctgagattctgcaatgtgattaaatgtcaacattaatatgatctgggaataaaatgccaacaacccaaagttgaatctaaacctcttcttttattaaattctcttttaataggttaggctaggttggctggctgtattctggaccctggggctctcaaatagcagcaaacaattcccagatctcatggcttaacactaggaaggtttgtttccatggacttcactggccagcctgggctctgccctgtgcctccctggtcttcactctggtgcccagctgagagcacagcagccatgtggaatgctgctggccgtgtgccagagggaaactgagcttagctaggcacacactggtgcctacagcttttcctggaagggaccatgtccctactggtcacatttcatgggccaaagaaagttacattgcaccacctgagttcaagagggcacacaagtccaatcctcccttgtgcctggaggctgagagctgaagtagcttgcaccactctaaggaccagcagagattctcagaaagaaattaaaagaggcaactaataaatatgcttggaagttaaagttcaaataattctgtgtcttcagtaaagtctaaaattaaatattcttgctcttgtgaagtcaaatccaaagtctataattcccagtcttatattaatgtccaatgaaattaaggccttcctccatttctttctctgtttattggatctctgttctctggatctgtttctctgttctctggatctcttcaacaatcagatgtgaactgggctacccttcaacatgatgtgcttaatgccttcaggacttcagaggatgcattaggttaggtcaatctctcatttcccacttgaaagagaagaaaatgatctttgcaccgccaagattctcacagcactgacattccatcaccagctaacttcattgtctagaggaactacctaatccaaacatgctctcgggacatcacactcggtaaaatcttggcccgtgttactgatgccaaatacgccatggaaactccatgggatctgagtgtaggttgatgtacagagaagaaatcatccttgtttttatctctgcaggatacctttggttgcagagcactgtgactggggcagttaactccattgcaagaactgtcccttcaccaaaccaataatggccctacttaacctgtacatattgtctccttccccagagaggtatttgttgagaaatatttgagacattgctatcttctttcaaagtatagaaatatacagaggtggcacactttcttttgcaccttgggtgtcatttcccctctagcccagtgtgtggagtcccctcaggctgctctgagagttggtcctctatagtgtcatggctgccactgaatcttacaggcatgtgtgcagtgctgtgacagagtgaactgtttctattgcctcttgttttgaaattgctaagacccgggaagcctggttccaggggacaatttccctctagtcctcatgttggttttcaatcaagaaccatccttagaacatttccaaaccaaagctgctgttattgcttcgagagtctttgctcccggagcaccactcctcacctttggctgcagcttggaatcccttgggggactttaagaatcctgagggccatactgtacccaaccaattgagtctttgggggtgtgtgatgactaattgtatgtgtcaacttggctaggccatggtgcccagatttttggccaaaagccagtctagatgttgctgtgaaataatgttttaggtgaaattaacatttcagtgaatgttgagtaaaacatattaccctccataatgtgggtggacctcatgcaatcagttgaagtctttatgagaaaaggctgagattcccccaaataagagggaattctgcctccatacaagcttcagcttgagccgcagcatcaactctgccctgaacctccagcctgtcagcctaccctgcagatttcaaacttgccagcctccagtcttgtgagccaattccttaaaataaataaatctctctgtctctatctccatcactatctctctatccctttatctctatctctgtctctgtttatctctatttctatttctatctgtctctatccccattcctatatctatctttatctctctctatccctatctccatctcgatctttgtctctgtctctacctctatctctatctacttctgtctctatctctatccctagctacctctatctctatttttatctctatctctcttgtcctatttccatctctatctctttctgttctatctctctctgtctctatctctatccctatctccctctatctctatcccttctctctctctatccctatccctgtctctctctatccctatctgtatctgtgtctgcatctctatccctgtatctattcctgtctatctctatctcgatctctattcctgtctctctatctctatccccatctctatctctgtctctatccctatctttctctatctcaatctctatcactatccctatctgtctctatccctgtctctacctacctctatctctatgtctatctcttctatctctatgtctataactagctctatccttatctctttctctatgtatctctacctctgtcttcatctctatccctatctccatctccatctctttctttatccctatctctctgtctctatctcctctatctcatctctgtccacttcctgttggttctgtttcttggagaaccctggtgaatacaggtggtgctgatcttccaggcactggtagtgtttagagctttcctggtgactacaatgtgcagcagggtggacagccccttcctgagggatctaaaaaggaccatccccctttttctctgcttcatcttttgttatttgtttgtttgacaattgtaggggttctctccatggatcgcgaccctctcctgcccctgctatttccagaaagtgcagtggcatttctgacagtagaacctcatcttaagatcattccccttctgtatcaaatgacttgctcttccatgccttgctccacaaactagcagcatcagtcttacctagagcatgacagacaagcctagatattgcacctactgagggatgatgtcctgaagtactgcatccacagctccactgttctctcagggtccatctgcagctcatcctccctttcacatctgcccaatctcatctcccttcctgcatgccctgcctcccctttgaaacatcagctttccttccactgaaatcactctccttccctccagtttaattagcctgactgcctaaaaaaaacaaacaggccagctgcagtagctcactctcataaggcgaggcaggaagatcacttgaggctaggagttcaagaccagcctgggcagcatagcaagaccctgtctctacaaaaactaaaaaattaaaaaattagcttggcatggtggtgcatgcctgttgtcccagctactcaggaggctgaggtgggaggatcacttgagcccaggagattgaggctgcaatgagtgacccatgatcctgtcactgcactccaggagcaacagggcaagaccctgtctcaaaaaaattataaaaataaacaactcttctacagctccttttcttctagtaaagtgaagtacactttcatagccttctagctcctccttgattcttctagcaaatatggcatctataaagtaatccagatgcaagacttgtcagtgcacttctaacctttgggttcacaaacactgaattaagttgtttttttgccactccactaaaaaaagacattaaaaaagtgctgccattccttcatttaattttcatggaagattcactgaaatgatctaatttctttgtctgtattttgactataaagctaatacatggctttattcttctttatttgttgatgattcaaatctactatacttctacaattaaaactggtctggaactctaaaatcgaaattcaggattacagtttatgcagctaaaaattgcaaagccaacttgagatcacacggtggtggtgattggggtaatggtggagtgatgtggtgatcatagcagtagtgggatggtggtagagatggtatgatggcagtatggtggtggcaggaagatgctcatggaggtgacagtaaccatgatggtggaaatggagcaggaggtaaaagttgtgatggaggtaggggtgggggctgtgatggtaatggtaatagtgatggtgatggtggtggtgatggttggtggtggtgatggtggtgatattggtgatggtgttgcctgtgatgctgtggtagtgatgatcatggtggtggtggtggtggtgctaatggtgatggtggtgatggaggtaatgggagtggcagcattggaggtgttgaggaggctggtggtgggaggggaatggttgtgacacagcctctggacaaggcacatagtaaggagggattcatccctcaaattcctctcaatgcctgcatacacctactggaatttgggacagtgaagcagggagtgtgggacagatgctgctctgttggcctggtcctaccgattcaaaacagaatatgaactcaccattgcctcctgaaccacacagagcccactgactattatttaggggccttgcctagaggccccactgaggtaatccagaaaggggcaagtatgttttcatcacaaatgccaagacagcaccaggctggctgctctcctggagtccaggatcaagctgcagtggctcccacggcagcaggcatgtgctgcaagccagattggaagcagttttgctaaggttcttccttattaaaacaagctctgttctgcactagctgctggctgtgagttcagagggcatgggtttatggtggtgccagtagtgcctatttgcagcggttccaagcagccatttgaccagactcccccagcaaccttttcaatctcaccaattcttgtttttcttggggttctcagctcatgtactaaaggcgtatggcaaatgccctctatacatacattccatacatgaaatgtgggagttttagggggaatttaagcaacacccctctgatgtcatttctgaggtatttgaatggagagagcagggcacgcagggatgaaaatacgagtttatccctgataagtgctggcttggaggacacaacttaggtgggcagtcagatgggctgggtgcttccttctcccccaactctcctctccccagctgtctagcccttggcacacttactccaggcttgtgtctccctaacagattcacttaccctggttgctggcatgcctggccattggaagaaagggaaatttcttcctttttttttttacattctttccctcaacaaactttattgagcacctagtaactgccaagccttgacaagacagaaaataattttgtttttctgatacttatgtttcagcggagacacaagtactctttgtttgattgccttttgctgaatgtgcccagttgaaactcactttttaacctgtgaggagagtgataaaaggacatactctttgggaggctgaggtgggtggatcacgaggtcaggagttcgagaccagcctggtcaacatagtgaaaccctgtctctactaaaaacacaaaaattactgggcttggtggcagtcgcctgtagtcccaactactcgggaggctgaggcaggagaatcccttgaacctgggaggtggaggttgcagtgagccgagatcgcgtcattgcactccagcctgggcaacaagagcaaaactccacctcaaaaaaataaataaataaaaataaaaaaagacaggctcctggagcttccttctcaggggaaggaggagcatccacttccccctagtcattcagagaggtcaaatgcagtcctctttgggaagtgactggatgtgcagagaaagtcagagggaggtctcgccgcctctcaggctgcttcgaaggatctcagtctgtggaccaatgggcttttctgcattcggctgccatggcttgtggcacattcagcaggattggtttctgacctcccatcaggctgggagcaccccaccgtgtatgtagctcaataccgagagatttgtaaaggtttttattgaatgactctaaggttctaagcctgggtaacttgggttataacagcattcataaatggaaatagagatattcgaaagacacttttttttttgagggagaaactgctgagcgcaggtttagacttcgtgagatgtttagaggacagcatattattttttgcatggctggatttaatggttgttttgcatccctttgcagggttgagatagcagaggactctcagaaaccctcacacccagcattaagaggcacacactagatcagtttgcagatacaaatctttgtggctctatactttctttaaaatcaattcccagtattttaaattcctcattattcctctatcatgtgttagacaaatatgatatccacagatctacaaatggctataactatgctgtcactgcagggatgtcttgctctctgaactgtcgtcaggaagcttataaataaatacgggacacatgaagctaatttgataccaacagcaataatataaactctgactaagggaaaattggaaagtgttgctgatctaacagcacaaagaggcattaggaacgtgcgtctgcatgtacctcactcccaggcttgggctctttcccataacatttggaggctgtgatttcacctaccaaatacctatttacatgcttagcctttggatcatataattcacatctctgagaaaatgatgtattgttacctaaatgtatcactgctaaatgagatcaactgaagagtatgttattattggcttcaaactatgagttggaaatgtccacacacttgcaccttgctttggtgctattatttgtttttgattttgttttgttttatgtttttgatgggagagtgcggggcgtgatgatcatggctcactgtagcctccacctcctgggctcaagccatcctcctgtctcagcactcttaggactgactacaagtgcacaccactgcacccagcaactgtttttttggtagttacagggtctagctatgttgcccagcctggtctcaaactcttagactcaagcaatcctcccacctgagcctcctgggtagctgggactacaggcactcaccaccacgctcgattaatttttatattatttgtagagatggggtttcaccatattgcctaggctggtctcaaattcctaggctcaagcggtctgaatgcttcagcctcccaaagtgctgggattacaggactgagacttcatgactgtccagcgctgttatttaaaatacaaactgagttctctacaaggtggaagttttaataagtgatgcaccttgtcagagtaaaagctttcagtgggggaaaatgtgctttaatttagttcatctaaatttctccacactctcagcacagcgattatcttgccttctatatcaccctgacacatactattaacctatcaaacagcagaaggctgagcaccaccaggctccaatctatacagatagttgggccaattcaggtcaaaattttattggttttggcctaaaagctgctggaaaaacttgtaaaatgaagagaagttacaatgtgattttaaagcggatttcaaagatgagaacaggataatatcagtttctggctgcaaagttttcttctgttaaaaacctataagttaaataggcacacaaatatatttctatgctctttaaactactgggtataaagtgatcacaattttaagttgcataaaaggactgcaaatattaaaacacttgactacaataaggttccttttgggccttaggtaagtaatgttttctggtgttgttccagaaagcataataaataaaataaaattatcctttgatcataccaaggggtttgtgacagtgtgtattagcctgttttcacactgctataaagaactacctgagactgggtaatttataaagaaaagaggtttaattgactcatagttctgcatggccagggaggcctcaggaaacttacaatcatggcagaaggtgaaggggaggcaaggcacgtcttacatggtgtcaggagagagagcaaggtgggggaactgtcacacacttttaaaccatcagatctcctgggaactcattcactatcatgagaacggcatgggggtaaccatccctatgacccagtcacctcccaccaggtccctccccgacacatggggattacaattcaacatgagatttgggtggggacacagagccaaaccatatcacagtgataccacaataagatatccataagtgtcagtttcttaaggcaattttccaaagtaccccacatcggatagttgaaatatctgagatgtattgtcccacagctcggaaggctggaagtcctagatgaaggtgttggcagggttggttcctttcgaggctgtgagtggggatctgctccagggtcccctccagcttctgggggttccttggcttgtagcaacatcactccaatctctgccttgtcatcacatggcctcttccctgtatgttcgtctgggcccaaatgtcccattttcataaggacaccagtcacactggattaagggcctatcctactccagtagaacctcatcttacctaagttacatcttcagtgaccctcttttcaaataaggttattttctgggcattgggactttaacaaatgaattttgggggaatctgatataaccgatcctaccccccacagtgatgcttgggcacctcagggagcacccccctctcagccctgcatcccagtccctcatcccacctcctgctcctggctttgttgtgccttgttccatctcacggcctcacccgcacaccgccattttggttgggctgtctgctttgtccctgaacgctaccttctaatcttcccttgactcctctcctgctcagagcccaggctgcctaaatcccagaccagggatcggactctgaggagcccccatttattcagtaagggagtgtctctgtccccttaataaactgttatcctgcttcttgactcatggaggaacagcaagtcctgaagaaagatgcaggaacaagggacccagaaacccagccaggtgggcttacggcatctgggaaactgtgttttggaacaagatttggggcctatttgtgagcacattgtcctaaaggcatttttgagcccaggataggtaaggaaatggaattctctgctgagatcactattaatatcttacaccacctagaaaaaaatggtgtctaaaatatccaacctgtcagacaaggagctttgattgaagatgcaatcacacagccaagccaatgccagctgacaaaaggagtttctggggtgggaaatgggtgggatgtgtccagggatttaaaacccaatccttgcaggtttaaacgaagtatgatttttgacaggaggttctcagtggagtcttgtatttttctacaatttttgattagggcctcatggactggaatctacctattctctgtctggagtcatagggtgctagtgggtaagtgtgatgttttcataggtagcagttctataaggtctcctgtacagtcatctgtggtattttcaaatgtttacctctgctctataaagaatttgggtcacttttgactatgtaagactttggtctgaattatttagactaccacccctactgcagtagtattttagaattccttctacaacttcagtggctatgacatttactaatcttggcatatgatttctgaggaagggttgcttaaaataaatacctaggcgcccagatacagaatttagctatggtgaaatctcaactgttcagtgtctcctgaaaatcagtgatatcttctggatgaccaaattgaccaaacacttgaaggctaaacttattcttccccagaacattaaaatctaagtttcacttgtatcgtattttgtttttgctggaagtgtgggctttcttttaaaatagctgacatcaatcaatcaaaccagtttcttaatagtttatcatggtccccgggcactccagttattttgtcatgtttccttgtggctccggttgtattaacagatgcaaacttgcatgtagaaggtgtgagggcacagagcatgttgcacatctgtatagagcttgctttcatgggaatctgttgatattaatttcagatcatttttcttctcatcaagatgaagtgaggcacacaaaggccacttggttgaggtcattccccagcctctctgcagacttagagaatcaagccctgagtccatcttccacggagtgtttttcttaccttcctaaaagagactcatcttctgattagcccagttacctttggtatcttggacccatctatggcttggatctactttcccatctctagttctttatgaaaggttcacgaggatttttttctcccttctacagtaatttgtgctaggagagggtacagactgactctagatcaggggttctcactgggggtgattttatcctcttccttggggatattgagcaatgtctggagacattttgattgtcatgatgagggggtgaggtgctaaccctaaccctaacccacctagggagtgagtggaggtccaggatgctgctcaacatcctacaatgcacaagacaggcccccacaacaaagcattatccagttcaaagtgtcaagagagttgcacttgagaaaccttattctaaagaaaataacactttggcaacataaactgagctacaatctctttcaacctctctttatctgtgataattcagagtattaacctctgttagcaattgcatcttaatattaaagttcctataaaatgcctccctgatggataaaccttttcatatagtttcttctctaacacacgcttcgtaaagcatgataatccataggttgaatctagtaaaggcaggaagtgaaggtaggatgccagttaaaataaatacatgcaatgttaactctgcaactggaaggagaactcagatactgtcttgcgctggttgagacaacttttttcaggtgtcaggctggtatctgcattagtttcccagggttgctgtaaacatggacacaacttgagcagcctaaaaacaatagaaaggctgggcgcagtggctcacgcctgtaatcccagcactttgggaggccggggtgggtggatcacaaggtcaagagatcgagaccatcctggccaacatggtgaaaccccgtctctactaaaaatacaaaaattagctgggcgtggtggtgcatgcctataatcccagctacttgggaggctgaggcaggagaatcgcttgaaccagggagtcagaggttgcagtgcaccgagatagtgccactgcactccagcctggtgacagagtgagactccatctcaaaaacaaaacaaaacaaaacaagcaaacaaataaaaccaatagaaatgtactctctcacacttctggaggccagaagtaaaaaattcaaggggtcatcagggccatactccctctgaatgctctagggagagtcctttcttgcctcttcagctgctggtgttgccagccatcctgggcattcatcagcttgttgttgcatcactccagcctctgcctgcgttactatttggacttcttccctgtgcatttccaaatctctctcttgtaagtcattggatttaggactcattctcatttagtctgacatcatcatactgtatctgcaaaggccatatttccaaataagttcacatttataggtactccatggagattagaacttggacatatctttctgggtgacaccattccacccacagcagtcagtagccaggatgtatgaggcactttacttccccacaccacagaagtccttttgtccctgtcaatcacgcaccgtctgtctctggcagtggcaatgttgttgctgagtcagattgctggtggcagggttgtcatttgcttgtcttcatcatgtatttcagcctcctgtgtcttttcctcctctttcttctttattttcccatcaattctccttgtctgcctgattttaccaccagaagctaatcatgatgcactttcctttatgataaagatgctcaccccattcactgagcatgggatccgactctttggatcttcttggtggtattcatttgctgcccattgcctgggagcacctggtaattgcagaagatattttcctctaagtgcttaaatgctggcagtccttaggggaatctgaggcttccataaaactggacttcagatgacaaagccatgctacattaatagctctagagatctgcagttgggatggcttatctttcagatgccatcattttggcttttaatttgtttgcgaacaatatcctttggggagctgcatccttcaacgtctgcctgcattatcacatgggcttcttccctgtgtgtctccagatctccctctcataattcatcggatttagggctcaccctaatttagtttgacctcattttgattatatctgcaaaagccatgtcttttacctgagggtaacagatagtaagaacttgtgggcatcacctaagagcagggagtgaaaaaaccaactgaggaaagaaaaatgcagggcccaaaaacctttttaaaatgtatttatttatttgagacagtcttactctgttgcccaggctggagtacaatggcatgatctcagctcactgcaacctctgcctcctgggttcaagtgattctcctgcctcagcctcccaagtagctgggattacaggtgcacaccaccacgcctggctaatttttgtattttcagtagagacagggttccatcatgttggccaggctggtcttgaactcctgacctcatgatccacccacctcagcctctcaaagtgttgggtttacaggcatgagccaccacacccagcccaggaaaccttttaattaaacaatgtagtcgaggtctgtgggaagaggcagaagggataggattgtccccaccctctgtcaatgttcaacagcctgaaacccccatcttgttgtaaccctgatgttgctgtgtcactgctcaagcagaaatacagaatgtcaataccagagcaaagatggactcttgagctgtgttctattggtggaaccaagggctttagttggagctacgaaagcggcataagtatacagaggagtctagacagtaagcctgggcaagccaggcaatgactggcagaaagacaattattattcctgccgtgtgtgcaagtgcgtgtttggaggggaaagatgaggtctgattgtcttcaggctttccaccagattagtgtttcccatgaaacctggaggttcatggacgtggtcttttgggggatggttccctgggtctttttttgcccttgtaaaatattgacaggtaagttttcaacaagaatgctgctgtcgtctatcttgtttaagattgccaccttcctctgcctctgaaatctccataccacttctgtgctttattttcctcctaaacataatcattttcaaatatactatatatctactcatgaatcttgttgattacttccttctccttaggacgtgagctccacaagggcagagggtcttgtctgttccattcactgctgtgtcttccgtaaatgagacacatggcccctgggccatcctggcttcctcatccttcaacccttcaacctgcacatacttgttattatgtggggtgtgattttactagagggaaccattcgatgttgcacatataagggatttgtaaaatgggaatagcaatagtattgagccgatgtggctgtcgtaaatgagtacctgtaaacaacagcaacaacaacaaaaaaaacccagaagcagcctgacctagaatgagtgcttggcagtgtcagcccactcaccaagaccctctgatggtgcttgctcaagccctggtgctctgctgccgaaaggaatccatatgtttgggtttccaccaagctgaaatcttaattagcataatatgtaaaatcgtgtcagtgttcagtttttgctcccttcccccgccccccgtttatatttccttaacttttggtacttggtcattgcttctctgttagggaaactactaataggagggaaaaaatgctaaaaatctttcagggaagggggaatgatcatgcttagttcaacaacttgcatttttaaagatttatgcatacatctggttttgttttctttaaaattatccttggctttataaatgcctatactcaatccaattgaatatatcaatgtttcctggtcttccataattgcatcatgaccccaaacacttagtccactcactaatttaattgtttatgtctggccatccaggcagacccatgcccttggtatgtgagcatgcttatgcataaggttagcactaacaggcgttagatgctttcagctttgctatatgttgtaaaactaatgatgatttgcagaaatgagtaggaatatacaattactttatggtcaaaaatttgaaaaaatacttgttttggctttcactgacactatgtaattggaaaaaaaaggtgatttaagaagaaaattgatttacacaaatgttttattaaggcctttgatttccatgcagaagggatattgatatattacttattttttaattgccaaatccttagtgaacattaaatgacacaaaaaaggattgtggcaaattggatctggaaacaagagttgttgctcttttaagaccaaaggttgactgagccataacttgccaaggtgattggagcaaagtagatgtttattcaattatttaactcaataaataattatgtgctagttttgttcctggcatattgtgtacacatggctgtttgccatccaagagggtatatagtacatttgggagttattatcatgtaggtcgagttggaaatgtaaagcgaatgaacatgtcttgggagataatgtagaatgaagagaagacaccactgtctttggatgggcagaccagctcacaaagaagatggaggaaatgatggaaaatgacaacaggagaaagtgtggtcttatagaccaagggaagagggagttcacaaaggaagaaacagtcagaagcatcacatgccacagtgagggtcaagtgagagtcagttgctatattgctatatttgttgctttggaataaggagggctgagtaagctataatgagttatttgggctgaagatgccaaacttgaggtcagtggttggaaaaaggaataaaactctgtgtctcatctgagtggccaaatgtgcctttgccatggcagcacctcctgctccctcacctctctgttatgcagccaaaatataattaagtgtatgattgagatatgctcttttttccttctgagcacaggatttctcaaccatggcacagttgacattcgagacccaatatttctttgtggtagggtatgccctgtgcattgtaggaggtttagctgcatccctagtctttgggggccaggaccaccaaactactgccccaaagttgtgacatccaaaaatttcttccagcagtgccaaatgtcccctgggggtcaaaactgccccaggcaagagtcattgttctagatatgtagccagggagctcaagctgcttattttgaaatgctcatcaggatagaggtgcggaacaagcagattttagatggaaactgtctcagccagaaacctggctaagaaaaggtgcgtatggtgatgaaaaccaaataaccaagtaactcagaccttaattatttaagcaaagtttatctcccctgaagcaatgaaggaattgtctctagaaggtcaacacaagactgtaaaagtcaataataaaagattgctcctagtcacatacacacaccttcataaactaaacatgaggaagcaagattggctaatggtgatggcggtttgttgtgggcatgtggttagcaggaccctccacctctctgaccataacgccctttggtcttcagtagttgatgacaataccagctcagagtcatataatttgttctctacctcatctctgccttccacagagcaaaaattcaggtggtcctagttttaaaggtagagtaatattttccccctttctcccttttgttctccacttggtttgtttttctgctttctagaatctggaggacattcctggcccttagcagacttattttccccttttcttttgcttaatctaataaggcaatagcatgtacaaaccatccagcgagaattttcctctcctacagagtgtgcggctgtgactcaggatttggtgtgtggttcacttagccagtcaacaaacaatggctgcaactctgttagcactgtgctctcacaggtgagacaggtccatgctctagacaaaacagttggctgccatttttcatttgaacaagttttgttcaacttgggggtagagataataaacaagtcaaatgtaaatttgaaagacaaaataaatacaaattataatcattggcagaaaaaaagtgaagtcctgtgatgggtttgagattatcctagattattttagtgggtccaatctaaacacacaatcccgtaaaggtagagaatcatctttcccagctgaatcagagagatgagacagaagaagagattcaaagcgtgagagtaacttgccccgcccttcatggctttgaagatgaaggaaagacgctgtgagccacagaatgtgggtgacccctggacactgggaaattatctcagctggcagccattgaggaagtgagatctcagtcctacagcttccagaagatgattctcccactaacctgaatgagcaaggaaacggactttgctttagagccttcagaagggagcacggcactgccaatgccttggctttaacccagtgagactcatgccagacttataacacatttctgttgtttaagctgcaagtttatgccaatttgttacagcagcaacaggaaactaatacactgggcttggtggctgagtggatatggaggagggggaggaccacagggtggactcctagatcagccagagggcaatgagtccacataccaaggtgagaaaactcagggagaaatggactatggagggtggaaaccagactgacgttttggtcatattaaatttgaaatgtctataagacatttaagtggagatactagcaggcaattgactatgtaagtctagggttcagaagaggagactgagctagtgatgactttctggactagaagaatacagatccaaggcaggaggatcacttgagcccaggaattcaataccagcctgggcaacatggtgagaccccatctctaccaaaataataataataataatgagaagaagaagaagaagaagaggaagaggaagaagaaggaagaagaagaaggaagaagaagaagccgtgtatagtggtgtgcacttgtagtcctcgtaattaaataccagcctgggcaacatggtgagaccccatctctaccaaaataataataataataatgagaagaagaagaagaagaggaagaggaagaagaagaaagaaaaagaaggaagaagaagaagaagccgtgtatagtggtgtgcacttgtagtccccgttccttaagaggttgaggtgggaggatcgcttgagttcaggagtttgaggctgcagtgagctgtgatcgcaccactgcactcctgggtgacagagtgagattgtccctaaaaaagaaagaaagaagacaggtgacaacatgcaacatggaactgagtggatgtaagaagtgagtgtggctggagaagcaagactaagtccaaatcaaagacaccacagtatgtgaggttgggtgggaaaggaggaggacatggcaaaggtgtcagataaggacccccagtagggcaaggagaaaaccatgagagcacagcatcagaagggccaggagccaggcatgggctgcaacggaggatgtgggcagctgagaggactagtggaagaatgacagacaggtgccacgaatttggcaatgttgaatggatgctggtccttggtaagtctgcattagtagggtggcaaggatggaagccagatgggaataggatgcggaggcaggggtgaggcgattaaattcagacaacttgttcactagaaacagaagtggagagtggatctagaatgggtgagagtgaagagatggcttttaaagatggatcaaagaacaaagctggggtgtcacattacctttcaaatttattacaaagcggtagtaaccaaaacagtatggtgctggtgcaaaaacagacacatggaccagtggagcagaatagagaacccagatataaatccacccattgcaaccaactcatcttcaacaaaggcaccaagaacttacaatggggaaaagacagtctcttccataagtggtgctgggaaaactagatatccatatacaaaagaatgaaaatagccccctatctctcatcatacacagaaatcaaatcaaaatagattatagacttgaattttagatctgaaactatgaaactactagaagaaaacactggggaaccaccccgtgacattggtctgagcaaatatttcttgtgtaagttctcaaaagcacaggcaaccagagcaaaaatagacaattggaattacataatgctaaaaagcttctgcaccacacaggaaacaacaaactgaatagacaaaccacagatagagagaaaatctttgcaatctaactgacaagggactaataacctgaatatataaagaactcaaacaactaaatagcaaagaaacaaataatttcatttttaaaaatgggcaaaaaattgggacaaacatttttcaaaaagaagacatacaaatggcctacagttatattttttaaatgtttgacattgctaatcatcagataaatgcaaatcaaaaccataatgtagtatcatctcactcaagttgaaatggtttgtataaaaaagacaggcaacagcattaaggaaaaatagctaatgcatgctgggcttaatacctaggtgataggctgatagatgcagcataccaccatggcacacatttacctacgtaacaaacctgcataccctgcacatgtaccctggaactaaaaataaaaactgaaagaaaaaaaaatgaagataaaaaacaatatgcactattcaaaaaaaaaaaaaaggcaacgatggatgctggtgggaatgaagaaaggggaattctcatacgttgctggtgggaatgtaaattagtacagccactatgaagaagagtatggaggttccttaaaaaatagaaaatagaactttcttatgaccctgcaattccagtactggatatatatctataagacaggaaatcaatatattgaatagatatctacactctcatgtttatctcagcactattcacaatagccatagccaaaatatggaatcaacctaagtgtccacaacagatgaatggataaagaaaatgtggtatatatacacagtgtaacattattaggcccttaacaaaataaaacccctgtcatttgcagccacatggatggaactgggggccattatgttatgtgagataagccaggcacagaaagacaaatatcacatgttcttatctgtgggagctaaaaagtggatctcatgaagatagagaatagattggcggttaccagaggctgggcatgggaggagtacaaaggggtaaagtgggaaaaaatcattaaatgtctttaaactgtacacttaaaaatggtaaagatgggctgggcttggtggctcatgcctgtaatcccagcatattgggaggccaaggtcaggagttcgagaccagcctggccaatatgttgagaccccattctctactaaaaatacaaaaaattagctggacatggtggtcacgtgcctgtagtcccagctactcaggaggctgaggcaggggaatcacttgaacctgggaggcggaggttgcagtgagccaagatcgcaccactgcactcctgcctgggcgacagagtgatgagactctgtctcaaaaaaaaaaaaaaagaaaagaaaatgtaaagatggtaaattatatatgtatattttacctaaatttttaaaaaagatgagtcaagtttgtatactgatgtgaacgatctggtcggggaggataagtggacctggagagagagagagagagagagagaggaacagagagatagagagaaggggagagagagagaggagaaatgagaaagacagagagagatagaaagagagagagaaggaagagagagaagaggaatgagacagagagatagagagaagggagagagagaggaggaatgagagagagaaaggagagagagagaggaggaatgacagagacagagaagggagagcgagagagacagctaagggggaatgggggaatgaaaggacagaggagagacagaaataatatttggggagagaatatttggggagaatataggagatggaccccaaggcacacgcggaggaatcagcccatggcgttcactgtagtaggaagggaagctggggagatggatctgtagatttgtcagtgggaggcggatggaaaagaataaaaattcctggcagcacgccagctcggccttcccacattagtacggccgtaataacgacttgggagtaataatccaaaaattcggatgtggagagggagatgacactgcatcactttgatccaaatggcatttttatgatggctttaaatatgtttatgatgtttacaaggagaaagtctagaatgctgagcaaaaggatgcctttgggaaaggacattaacattttgctgacaacaataacccccatgcttgcctctctcctcccccaggccttgcactccttctagttcttttgttgttccacacctgcaaggttgaccagctgccccacatcaggggactcagctcttgaaggtgttatcccaggaatggtagtaggtctttctgagtcaaatcaatgtcctccaatttgacttccaagtgaacttgtaagcagagatactcattattcagctgatagtgttaacagagatggctcagattctagaattattcctgagacaggctaactggaccatctgcaatgattcatatcatgcgtggtcttcaggagtccacaaggagaaagaaaatatttaaacttttatgctagtaacttttatctcattcttttaaaactgtatgttgcagtatataaaagcattaatacaataatatatgcatacaatttatgtctgtatacaatcatacagtggtgtgatcaaaacctttatcctgaaggaagaatgtggtctcacaagcctacacacacacacacacacacacacacacacacactcacacacacgaccatgcatggcggttgtgagatagtaacgcaatggattttcattgacattcctattggtggttgtcctttcaagagtctctcctggtgggtttggatcgtaaagcacttgctgcagcttctgagctgtcacgtggtgctggcttctgaaggaaacgtttgcacctctgcataatgtttgagctaaaatgatgaccctacgatagtcatactatatattaattggcatatagaatgttatatatgcctgcagtgcacctttctgcagtgactaatgggcctagagaggtggcctctctgcaggagctgctcaaggcaggtgagcatggctatgttcctcaggaggacatcacctatttatagggccctgcattctttctggtcctcagcaaggccatttgtgaattgaggcaatcaatatcccacccacccgaaccccatgatttcttagtggaaatagccaatatccattctgagtttactcagtgccaggtgctactctgcattagtgctctaatgcagagaaacttatggtaaagataaggaaacagaagcccatgtggtcaggatttgctcatagctacggagtggcagaccgaaatttggtttcatctagtctgtctccaaagcccgcagtctgaaccatggtgatttttgcctcttgcactctcagctgcttgcagctgcaggcacaatgattccagatttacaaaggcccgcaagtttagacatccacatttacataatgacttaaggatttgcagatgtctgggaaaaattatcctgctcacttggattattgggactgtgtctcaactttccattttattttgcacgtgtgcacaatattttcaggtaatttctatgaaataatatcctgtcacatagttaaaggttataaacatggtgctttacctttgtttttgccttaatggccaaaggaaggaggttagcgagtgagcacatttgctccttttatctgcagtaggagcgttttgttggaagtatttccatgtagcagcatgaagccaaataagacatttacaaacagttttttttttaagttaagatatatgtttcatctcttgtttcacattgttgcactcaatatttgcaattgagttagcttaaagtaaagtgcatttattcgactagatggtttgctccagttgccccactgtgtttttttcttctatttgattgctgtcttggtactaagccagtacaaagacaggaatgaagatttacaaagttttcaaagattataatgggcccttgggtgtgatattttaaataggagctgactttaagtcaaaagctttcaaatcaaccagtaagtacttaacagaagtcctttcttcatgacaaggatgaaacacagagtggattacgcaaggtgaatctggtcagcccgggcctgaggtcacgtctgactcccagcaatggtgttttgcttggagacttctactgccctcttggcccctctgtttgacctggcatggtccatctgtagtcactctcataacatgtcatacattcctacacattctcattttctgtgctccttcaactttttttttttttttgagacagagtcttgctctgtcgcccaggctggaatgcagtggtatgatctcggctcactgcaatctccgcctcccgggttcaagcaattctcctgactcagcttcctgagtagctgggactacaggtgcatgccaccaagccgggctaattcttgtatttttagtagagatggggtttcaccattttggccagcctggtctcgaactcctgacctcgtgatccacccgccttggcctcccaaagtgctgggattacaggcgtgagccactgcacctggcctcaacttttattaaaaaacaaacaacaaaaaactgaggcagggccctgcctggtacccctgacagccttcggaagaagaaaacaggccttctctgtgggtcatgtctccagggtgtgcaggaccaaatactgctttattcataaaacaggtagctggaaagctgccccactgagactaaagggaatggggtaaatcatcctcccttcatttggctgtggcttctgacaatctagatagttgtttgcatacctgtgtgcacacctgttgtcattctgtttggacagatgactagcgtacaatacaggttcttcagaggatacgtaattaatcaaatcataacaacctcaataatataatctgaagaattaaaagcagggctctggtatttgttctacatagcattcatataaatgtccgattgctctttgcagcttacgcttggtagtcccaatcactctctagaaagggcttatgagcagctacctggaaggcctggattagggagtggtagcagatgtcatggttgagaggatctaggggaccaggcagataccccatcggacagtgggcatcctctaaactgtctctcactgacttcactatgaaccacagtaccataattttggtctttaccattttcaaaattttctgtttttcaaaccacaggttcaaactctatcgtagtttcagattagtagtccatgtttttcttatgactccacttatttaagaacttcagtgacatacatttatctccacgtagtgaggataaaaaagttgagaacaagaagctaatacgatcatcaagacacagtcacaggaagtaaaataggaaggaaggaaaaagaaaggtctaggtcttcagagacaagggagagatatggcaaggcagaagtccctaagagttcaatataaagacaggtaataccaccactcttaaggaaaatattcccagggattcaaagttgatcggttccatgtgtctaaaattcacttggacttgtaagagaaccccaactttaatggaagaagaaaacaggtaaaaatatcctcagctcagggttagtggcttttcttatctcaaataaagggaataactcattcatgttgctgggctttctttgtcctgttttaagaaatttcaagttgttggctacccaaaagctgcattctagacttcttcctcttgtcccactgggtagaagcatggcctgatattttccttcttcagtataataatttcattttaaggacagtcaggtcctctaaatgtgttattattttggttcaggctttaaaccgaataagccagccaaacattgataaaagcaatgtatctgagcttcccatatttactcggcacccagtgacatttggctcttatctactgagaatatgagagtgataacagtaggaaacttaagtcagagcctgcaggttcttatttaatatctatagacactaaaggatttgcatctggatttaaaaggaattactctgagaatatttaattccaatagttggaggaaattgctcctgtgatcagtacaatttgccacagttttaaacatgtgggtgacaatgactgactttcatatttctgtcctcggcagcgtgactgtacacaactgagtcgcagccactctcagaggggattgcagcctgcagctcacgtcttagagcttctgaatgcagcagagaaccaacttgctgagccactatcattattaacaaaacgttggggattttaaaagaatcctcagagagtcccagcaacatattcaatatggaatgataagggccaggcctttggagagttgaagaaaccattttcccagtaaacccttacatcaaatgtaccagtgacatctgattgcgctgtttcctctcttggaaatgctcttcccctcctcctcacctatagaaatttgattcacttgtcacaactgaactcgaatcctgcctcccccaccgagccaccctctctgaggtttccttccctgactccagttggaacgagtcctttcctacttaaggctattatgatatgaccctttgtccctaacacactgtacttccaaagcacacacgggtttacatgcccgtcctctactgcatgccagactgtcactcactgtccttagtgggggcgaggttctgcattagcaggaaccagaacagcaccttgcatgtccttaagcggccgggttttggggagctgaatctgttcatgcacacttggccttgtcctgttctcaaagctgctccacagacacggggctgtctcctctccgtggatgtccctggctggggcagcttcttttccatgcatcagcctgtagcacgatgtgcagtcttatgagcagtaagaataaatgtaatgtttcttacccagcaaccgcagaatgtgcacagctgcaagcagagtgtgtgcatgtgacagtgtatttgtgtaattgtatgtgtgtatgagagagagacactgtgcatatgtgtatcagatgtaactatctatgtcacgtaaccacatattagacttaaatgttactgtttcaagtttttaatattaaaaagtagattttgaggtcaggcgcggtgtctcacgcctgtaatcccagcactttgggaggccgaggcaggtggattgcctgaggtcaggagatcgagaacagctggccaacatgatgaaaccctgtctctactaaaaatacaaaaaaaattagtcggacatggtggtggatgtctgtagtcccagctactcgggaggctgaggcaagagaatcacttgaacccgggcagcggaggttggcagtaagctgaggtcgcacctctgcactccagcctgggtgacagggcgagactccatgtctataaaaagaaattgattttgattttccttttgtgcttgtcctctgatgtcaccttcctccccacaacacacactactgttgttaatttgttcagaccatgggttcctgactcacaattagaaagtggaagtgacagtagaaacacattgctttcactctgagcgcccatggtgggctgttccctattttcaggaggtagatgttcatgcgggaatactgctttgaggactacatgccttgagttcagaaaataagtttgatttaacgcgccccccgcccacccaccgccttttgttttgcagagaacgaagactcagtcatatcttaggatgtcttaggcctgaacctgaaaaaggcttccctgctttatgtcatcatcagtcaggatgctatctccctttatcttttgtcccgtgtgctgggaggacatggtccagggtgaaatgaaaaacaaagtgaaatgcataactttatttgcgtgtttctaatcatcctttaacagcaagaataatacactgtattataatagtcaaatttactctcttgagcttacttcatctggagaggtctactgactattttggtaactcttgtaagatttttcactagctcaagcagcatctctcaaagtgtcaactgttcacctttcactccagttcatgctgctttttctggctgtgctgctaggctgaatgcatcgctaacacccgcacaggggacacagcagattttagcagatgcctctgtggtttgcaatgggagggagcacttcccatgtgtcccaaatgaaaacaagcagaacttcaggtatgaatatatatgcaagtacatacaattagaagaatatgcagatgtacacatgcctcctgggcacctgttttcaggacagaaaaggaaagagtcagatcgtgtgtctctgcatgagctcaattgagaaaggggttccctcaccaaatattcaactcattgattgttgcaaattctgagctggatgctaatgaggaaatcaaacactggctccttcatcccagatttgtaaagcttattactgatagttttcagtctttccgtcttctaatttataacccaacttctaatgttcaagtcactctgctctgtgcaagaatctacccctccatggttgggagactttggcaaacccaatcagagatgaggacaaactgaatcagcaaaggaggtggtgctgaccaggttctgacccagcagcatgtcttgggaagaaactaagcccttcctcaatacctccccgccaagctggcactgctcattgactcagatcacaaatcctgggtaatctgggtggagcatgttgcccaacctcagtgacatttgctatttctatttttggaatagagcgaaaggatccaggagatcaattcggcttgatcctgttttttcctttctagtcaacctcctacagtgtgagcaatgaccctcactccacccccaggcatacacacccccctctacatcccacaacttaggcagtttctaagactttgggaaaatccctgggagttcctcataacacaaaatgccttgggctgtacaagcctaggagaagatgccaagctgtggtctaggctcagggaatagtttcgctgccccttcctccccacctccctacagacaccccccaccagccaagcagcctgttcccactgatgcctgactggggaaggagactgagtttgttagggccaaggccataagcacttatcactcagcaaccacaaaagcaactgggttttgtgttgatccctctaagattaggccttgaacctcctttgtgcaccccttcccaacagacaattgtacttctgtctgaaagttttaattaaatgactcctgcacaagctgtctgatttcaggagacatagcagcatctattggatcaacagttccattgtttgaaacatgaggactataaataggaggcagaaactgacagcacatttagtgtgtttgcctatgtggtaatggacatgaatagtatgggcactgagctggtgaacaacagaatctcaaaaagggaagaacacatttgcccaaaacattaatcagtatcaggctggcaggagagaatcaaagtagcttctgtggagagaagacacctcacccagagataaatagcttgcaagtattagaacattcacagtgaaaattaacccatttcctttaaaaaaaaaaaaaacttttaattttgagatacttttagacttacagtaaagttgcaaaaatagtacagagttccgtatccccctaatccagcttatcctaatgttagcatctaacaaaaccatacaaccaagatgacgactaagaaattaacattgatacaatgctactaactaaactgcagactttattcagttttctccagtgtttctgccacggtcctttttctgatccagagccaatccaggatatcaccctgtatttaattgtcacatctacttggtttggtccacatttttattactggttgtattttctgcacttttttgttctttgagacagagttttgccccttttgcccaggctggagtgcaacggtgcgatctcagctcactgcaagctctgcctcccaggttcaagcgattctcctgcctcagcctcccaagtagctgggattacaggtgtgcaccaccacgcccaggtaattctgtatttttagtagatatggggttttgccatgtgggccaggctggtcttgaactcctgacctcaggtgatccgcccttctcggcctcccaaactcctgggattacaggcgtgagccatcctgcctggccattttctgcattctttctacacttattaattgctgtttctctagaaggaagtgttattccttctcccccatttatttattggttttttccaaggagacatgacaattaaaaacagggtgatatcctggattggatctgtgacagctccttggtgttccctttactttcatgaccttcttacttttaaagagcattggtcggttatttcatagaacgtccttcagttttggtgtgtcttatgttttctcacgatgagattgagcttgtacattttggggttgaataacagaggtgatgggcccttctcagggcatcaggtcagagagtacgtgatgactatctgttttactattggtggtgttaacctcaatttttaggctaaggtggatggagttaacctcgattactaggctagggtggtgtgtgcctgtcaaaattatccactggaaagttcctatttttctttttgtgattaatagacatttatgttgaagggggtcctttgaggctataaaaataacttctttttttttaaattttgctcactaattttggtatccatgtgtagatcttgactggagaaatttttgttactggttgtattttccacattctttctacatttattaattgcaatttctctagaaggaagtgttattccttctcccccatctatttatttattcagttacttatttatatcagtatgaactcagcattatttattttattctttggataagaatgcaataatgcaatactataacaatttattttcctgatcaaattgtttcagctttggccgctgggagctcttacaggctggctcgtgccccctattgcaagcttctatttcttttgtttgactgcttctttactctctggtaccacaaatcctctatgctcgtcttatatattctttgctccagctttggaattaaccaatacttcaaaagtcctgtttccttttattgcaaagtcaaatttagaaccaagatctgggcaatagatgtgctcattgctactagaatgtcatttccactaggtcatctcagcagacagaactaggaaatgcatgtcatatgtaccaacccatatgtatatatgtatctatgtttatttctgcatatatttatctgtttatatattttaagtaaacacaagtttgtattgatactttggactccaattcagcaccacatggttcactctagccttcttccttatttgtaatgcctttccctgactgtgagagcctgactcacagcatctaccatacatttcttgttttgctaactcataacccagagacaaacaaatttaccaaataaaatacagcatggagtatagttcttgttgtctttagccttccagtatcgagtcaaaacagggtttccaaagatacctaggtcagctcttttgtcccccacctgtctcagtgagccttggtgattgattaatttctgacacagttgggtttctttcttactgtctgtgtttcttctcaactgcccccccttccattcagccaacatgctggttgattttaaaaatttaacttacatataacaaaattgtaattctgtacatcaaatttgtatgtcactctttgtgacatatagttttatgcattttgacaaagtgatagtcatctatttactgctatagtttcttagagcacaattccattcccactcccctaatttcctcatgatccctgcttgtagtttgtcctccccaccatcactcaactcatggcaaccactgatctgttttccatcttataaagatggaagctgtaagcttcacctcttccagaatgttgtataaatagaatcaaacaatatgcagcctttgggatgaacttctttcacatactgaaaagaatttaagattaatccatgttgttgtttaaattaacaatttgtttctatttattcctcagtagtattccatgatacaggtgtaccatagtttatccatccttgtttgaaggtcacatgggttgtgtccagcttttggccactatgaataaagattctatatagatccacatacaggtctttatgtgaacatatattttccttttcttgggtaaataactaggattgggattgctgagtcatatggtaggtgcaagttgaacactataagaaaatgctcaactgtttatcaatgtggttggccatttttgctttgagcgaatagcaacatatgagagttccatttgctctgcctccttgctggcatatagtattatcaagatttatggggcttagccattctaataggcaggcagtggtattaccttgtggtgttatttacatttcccaaatgactgatgatgttaatcatttttcatatgcttatgcaccatctttatttacatgcctgtttagattacttgcctatttaaaaaatattgggttgttcattttcttatttttgagttttgagagttctttattgtattctggacacatgtcctttgttagaaatgtgatttgcaaatatcttctcccagtttgtggattgtctttctaattttttaagcgtgtccttttcagagaaaacatttttaacttttataaagtccaactctttctttcttccttttctttccttttttttctttttcttttccttgagatagagtctcactctgtcacccaggctggagtgcaatggtatgatcttggctcactacaatctctacctcctgggttcaagcaattctcctaccttagtctcctgagtagctgggattacaggcacccaccaccatgcccagctaatttttgtacttttagtagacacggggtttcaccatgttggccagtccggtcttgaactcctgaccttaagtggtctgcctgcctcagcctcccaaagtgctgggattacaggcatgagccactgtgcctggccattattttttcttttataaattgtgctttggtattatatttaaatactttttgtctaaccaaaggtcattacaatttgcttccatgttctcttctataagttttatagttctacaatttaaataagtctattatcaactttgagttactttttttgtataaaatatgaagcatagtttaatattctttttaaaaatataaatgaaatattcacatgaatatgaaattttttcataattccagcaccatttgttgaaaatactattctctctacattgaattaattttgtacctttgtccaaaattaattggctattcttacgtggatctatttctgggttctcatttctgtttcattgatatgtatgtctggccttttaaaaatattatattatcttaattattgtagagtcatcataagtcttgaaatttggtgctatgagtcttccaacatttttcttctttttcaaaattgttttggttattctagatactgtgcttttccatatatatttagaatgagtttttcagtagctaccaaaaaagctttcttggattttgattgggattgcattgaacctatagatcaaattaaggagaactgacatcttaacaatattaagtattctaattttgaccatggcatatctttccatttagttagatcttgtttgatttatcagaatttttatagttgtcagcatgcagattctacacactaaacaaaaaaaaagatttatacctaagtatttcactttaggagccactgtaaatttattttaaaaaaattggtttccagtggttcgtttctagtgtatataaattaatatttgtatgttgaccttgtgtcctgtgacttggatcaacttgcttaccaaatctagaagctttcttttattccctagtttcttttttagatttttgtatgtagagaataatatctgtagagaataatatctataactagagacagttttatttcttcttttctagtctgtatgcttttttttttttttctgccatattgcacagactaggaacccagaacaatgctggataccaggagtgagagaacctccttgacttgttgaagatcttaggggaaaagatggaaagtctttcactaataggtataattataattaattatttcaatatcctttattggttaaaggcaggttcctaggtgatcacaagttttttttttcacgaatagatcttgacttttgtcaaatgctttttctgttatctattgaatatatacatttttttttcctttttagtctgttaatatgttaattacactggctgctttttgaatgttaaatcagtctggtagtttttggaataaactccacttggacatgatgtattatatttttaatatatcgtttgctgaaaaaaaatattggtagaatgcatttattgttggcagtaaagacctccatgttctttaaaagccaaagaccagggccagagtactgctggaagctaatctcctccctgggagccacacagataaggttaactggaagcaaagggctctggaagagaggaagccagggtgccgctgctgcgccccgttcctgcctggcttggacgtatctggaactgacctcattctttcactatggtggacagaattctaaagctgtctttctaagatgtcgtcccctggttatataatcaagcgctaatccaggtaatgctgtgaagggactttgcaacccaaattaaggaggctaatcacctgacctgaaaatatggcaattatcttgggttactgagtaggtccaatgtaatcacattagctcttaaaagcagaagaggaagccagagagatgcagcagaagggctggtgggactggaaacatgagaactttgtctgccattgctagttttgaagatgaagatggaggaagggaccaccgaggaatgtgggtgggctttagaagccgagaacgatgcccgcaaggaagcaagcaagggaatgcacccggaacgactttggaagcagatttattccccaaacctccaggaaggaacacagccccactaataccttgattttggcctatgagacccagagcagagaacaagctgaaccccactatgtgtggacttctaacctacaaaactgtgagataatagatagacactgttttaagatgctaaatttgtggcaatttgttaaggcagcaataaaaaacgaatgctttggcttagcaaacatatacggaagaccttctatgtgtcagggactgccaggtgctgaagataaggagactgggaagaaaaacgacctctttatctaaggggcgcaccaaccagagggagactataacaccaaacaaaacatggaggtattccgtatatgtgccgtaaaagcaaagcttatcttggttgcaaagaataaaaagcaattctggctaactttaaataacaaaagaaaaaaaaagagagactatgtgcttttaattttgagagcaaagatactggaagattctagtttgaatcttctagtttgaaggaaacttcaaacatgtcagatttggggaaaggacgaccagtacattcccaggaaccttagtcatagaagtttgtagactttctgctggttctttaactctgaacccacagttcttggccttaatttatcctttccaaatttaaaattataagagggaaaaagacaaggcttagattggtcctcttcaaggacggcatcaatctattcatgaaggatccaaccctccccagcccaaacacctcccattaggccccaccttaaagactagtaatcaaatttcgacatgaggtttagaggggataaatatccaaactatagcaagggtaacctgttttacttagagtccattaaaaaaacatcttcacagcaacatgcagcctggtgtttgatcaaatttctgggtaatgtggactaggcaagttgacccataaaattgaacatcacatcttgtggtacacataacccatggggtctagctctatgggtcagagcctcatccccagaaagaagcctctttatgggccttaaagttagtcaaacaggtgctcccaagactgtccagttgtcagccacacttcaattacccctacaatgaggatggtaatactcataggattttttttgtgtagcttggaaaaagattatgaggataaaatgattttgttaactgttaagtgatgtgcgtatgtgaagttggcattatgtattttaaattaagattcaaggaaagttggcaaactttgaaatctagaatttgtacttgctactaaaaacgagtaatttttaagtgagacgtcaggaaaccccaaagccttttcgtgattccaaatgctgtcagaaactcctcaaagcaaaactccaccatctgcactttaaattgaaaagtgtggcgagtcctcagggatctagaactagaaataccatttgacccagccatcccattactgggtatatacccaaaggactataaatcatgctgctataaagacacatgcacacatatgtttattgcggcactattcacaatagcaaagacttggaaccaacccaaatgtccaacaatgatagactggattaagaaaatgtggcacatataccccatggaatactatgcagccataaaaaatgatgagttcatgtcctttgtagtgacatggatgaaattggaaatcatccttctcagtaaactatcgcaagaacaaaaaaccaaacaccacatattctcactcataggtgggaattgaacaatgagaacacatggacacaggaaggggaacatcacactctgggggctgttgtggggtcaggggagaggggagggatagcattaggagatacaccaaatgttaaatgatgagttaatgggtgcagcacaccagcatggcacatgtatacatatgtaactaacctgcacattgtgcacatgtaccctaaaacttaaagcataataaaataaaataaaataaaaagtcatgaagatattaaaaattttttttaataaaagcacgatccatataaggaaaaaaaaaaaaaaaagaaaagtgaaactgcgatcatccctgtctatcaggaacagccaggggctgatgaattgcaacaggatagggttgtcccaaccccaaatgacaaagactcactgccctgaaggataaaagtgggaaaaaacctaaacaaaaatcacgagttgagccagagatgtttgtgacccaacagaacatggatttttcacgttctcttgtgcttttctggtctttactggatgaaacatcagagcatctatgctgattgtattctgacaaaactatcagaggccagagtgagtcttacaaattttgtgtatcttattgcttcacagtcagtcccttctttatagcatggctgagtgctgaacttagccccaactttttaaaaattaaaattggtcaatattgcaaccctttcctagcccttctgtcttctgtccctccctcccttctatccttcttgcagatgtaattcaggcagaattctgacattcatgtatcaaacttgctgttgccggcatcattttgcttagtgttcattatcatttctgaacggttctatcaggcaaaggcgtcctcgttctccaagcaaggaagccccagccagacagttgtcaaggcaacggaaaatgcacactgtgaactaccaagaaaaggccgtttctggctgctaagagtttttgcactcttgaggctcaaacttaatttctgggcttggcaaaaagaagtattttatggctaattataaaatgtacccaatgttattagactaggggatagatgattgcctgctaaatgtgttgtgaaaaattaaagcagttttcagagcggagggagctaaactcagtgtgcccaaaggatcgatcgcttatttttgtcattctttatagctggaatacaacagttgatttgagtctcattatctattttgttgtcttaggtgttcaaaacaaggtagaaagtgcaccgtccatatttagactttttttggttggcgggggtgatggttagggcagcgtttaaataacatgtttcttggtccacattaagagccgtacattacacttagcaggtgagactataagatcagagtctgtgggctaatttcgtacattagctgctatcattgtcttccacatctatttatttatttatttttgtcttctattctcttcccatgtacttgcttgtcaacaaaccccaaataaatgccacatattaagttaataaaagacatggtagttagggattgaaagtgtcagggtgaaaacactggtatgacaatccgccttcttaataaggttgttcttttgtaaacaatgttttaaaatctaactttatatgaatggttgattcaaagcctggtggccagtgttacagtgaatctccattcaccgtaatggagattcactgtaatggactcagttaatccagtcgttgaataatccatgttaagccttcactttttttctttttgggtgagcctccactcattgaaaacaaggtaaacttagactgaggttgacatgattgggtatctttcctcaggatctcccccttaagaaaggaaaactgaaccatcctttagaagaggaaatatgatttacctgaggaagaggtaatatatttctttctacactcagctgattgatcatggaataaaacagtatttgtagtcctctctcaggtagagaaggctcatgaagttgatctcctaaaagaaaacaatgctatggaaactaagtatgttttaatgtttaatgtgcatcgtatttactcataggtattcaaacaacatccctccctttagcctgaaatgttcccaggattgtattttatacactaggcacattgatataggcaaaggaatggggaaggtaattatccagcaatcagacatgtcaaccaggcttgtttggataactgacagcggtgaatcaggttcatcgcctctattgctttgtgggactttgtttctctttatagcatttccacatgtgttgaaacagggcctaaatgtaggtgttcaggatattaaaactagagctttctaaaaggactgagtataattaactcttgacttaagttccttctttaaatttcatttctatctgtggtttagaggcagtgggaggctgtgaaatggaaaaatggaccaaaataagaaactgaagtgaaatgaaatgactgaaatctgtttccccatagccagctttctggagcgtttcagcagcgccagtcatccttgcatacactgagtttctactacattccaggtgttgtaaaattttctttgagtggggtagaaagtaggagaataaaaatcaaagtgacgcctggtccagctctcaaaaacctcagattctaatcaaatgcagattcggtctgaatgtgcatcatcagaatgtaccaagggcccctatcaacgtgtatacagtttccacaggaacacagaggagagagcagctatctctgcctggaggagttgggaaggttccactgaagaggtggatcttgaagaatgggtatgagttcaacatatagagaaatgggatatgagactgaaagagcattcccaacaatgcacatgtggctgagaggaagagctcgatgcatacgagcagtagagagttttttcacaaggcaggggactcaggccacttgtatggatggaaaggaagggacttaagaaaggtttttaaggcaggaagagctggctgtctccccgagacgcttctgataagctgtgctaaagagcttggcatttagctcctgggttacagggcctctgaaaggttttaagcaaatgactaccctgaagagactctggtgggtggaaagacaaagcatggattggagtgagaattaaaggtggagacaggctcagggattaagggatggttcaagggagatacacggacctgaacaaaggtagggggcatggggatggagatgaaaggaaaccatcagaaaagaaggggccaaagagggaggttatcttggcagaagaaagacattattcatcttggttggttggaaatgtgggtctggagctcataagacagatcatggatagggatatagctcagggtctggggtcctgactccccctaagggtcttacctcagagagtgatgactgagcttctggaggtcttgaatttcctgaaatttatgtaaaatggaaggtgcatgtgtatacatttcctagggaataagtcaatagccttcatcagtttctcaaatggttggaaaatggaatatagaacagcaccaaaaaacactatcttaaatgaggatctatctacagggtgttaaacggaagtgagagtaacccagtgagcaatggagaggagagaaggtcccggcagccttgaggccccttcccccttaagctgagcactcagtgtcactcttctcagctccatctgactgtccccatctctaatctctccccatatgtacttcatatgaatcaaaggaaataacatagagagcttgtaaactctgaaatgctctgcaagtgtttagttatcatttaaaagatgaaatgaaatatggcaactccatttaagcttttattagttctgcccatctccatggaaaatatctgtgacattcaaaatgcctgttgatgctacattcactaatctttttattaataagtgagcatgtaaagttcacacacctcagacactaagatatgctatcagtacacatcgatgccttcctcctaattcagggctgggtaggatgggcctgagacaacacagatggatggccaatgactcagaggtggaaagtggaatgcaacccagcagtactgtgcagcgatgcagtcagatagaaacaacatctaacttttcagtgcagcttaaatgatgttgaattagccatggtgtggcggcacgattatgtctcaacatcactgtgctaaatctaaaccagaaggaagccctgtgtgcagagagcgatggtagcaaaaagctctattaagatttgtttcagaacagaaaagagtcaatatatactataaattaaaaaaaaaattgtcaccattgtagccgatgtgagaaattttggcatgctatttatagcccagattcccatttgaagtaaaatgcagtcagattgcaagaacagggttttgagccatagaattgatcatagagctgatggagccacatatcaagaattgttgatgggagtgggttctctgcatttagacttctgagatgagggataaggaagaaccctctaatccaggtgtctaaaatagccatgggtcatttaagaaaattatccaccaaagattccttaacaaatttttttctaaaggcgggtttaggcacatggtaggaaggaaaatcaaaaagaatccctttcttaaatgagttattaaagaaatagatttgattagaaatgaactcatgaaattaaaatgttaggatgattgaaagtagaacatcacttttttcttgtgaaggtcaaatgaggggtgtgcttgtgagaaaggaaaaagacaacagcaaggaaagcaaattaaaaccaacatcaggttgtgcaatggactaaatgtgttcccttaaaattcatatattggaatcttaacaccaatgtgatgggaataggaggtggggcctttaggaagagattaggtcatgagagggggccctcataaattagattagtgcctttttaaaagggacccccgagagctctctctcaccctgtctccccactgtgaggacacaaatagaaggcagctgtctgcaaacttggaagggagtcctcaccagaacccaaccctgctggctccctgatcttggacacatgcctgttgtttataagccaccatctctatgacactttgctatggcagcctgacctgactaaggcaagctgggagttagaactctcaaattctccgaatctcagccctgacattcaatagctgtgggtggcatgatgggcatggcactttacagatttgtttcctgacttttaatctaaacaagaaagagcacaaccactactgcctacctgagatcattgcacacaagtgttttataaactgttatataaataatttattttggcacaatcttgaaattttaaatgtctatatgaaaattttctctgcttgtcaccactacctcctgtccttatagaaacgtattttcatgagccatttggttcagagtttaaaagcagggagaataattattcaaccataattgatgtcaagcaatgttgtaaaatctcttaacttatcagagtctaagcactgttggttatgaaacccaaataataacaatgcatgtgaaagtgttttgtaaactttaatgctcaatgcaaatgtcatttatttatttcagtttctctcttactaaagtctgtttttctgatctttttgctgctggtatatttttgccctagtaagttcaaaaaaattaaaaagtcgtaattcttggcttcagatacctccctaggaattctgagagttttttttctatatagatctgcattgcctgcttgattccagcacatctcaactgggtagctcctacgccaaccatttatttcatgagcttgcatctcactctcttctcaccttctccattaacctttaccttggaaacgtcagatctgctcccatctaagccaaaaacactatccaattttatatccattaggtaatgccttgtgattcaaactacatctcaagattctccttgttgagaaagcttatctcaatgtgcttggaggggtgacaaggatgcaattcgttaatcattgtaactcttcatatttagagaatgcagcaattaaaaggtgcttcctcataaacatgtgaccttgtttgatcttcacttctataaagaaaaacatagtacctataattatttaacattattccatccattgtgcaaagtgagaaaaccaacaatgtttaaatccaataaagtccaaaatctctcagatgataagtaaaacagtgaagtttgcattttttctgtctacatctaagttttttttctttcaggattttttctttgtttttggttttctgaagtttgaatatgatatgcctacatgtgtattttgtttgtttgtcacttatcctgtttggtgtactctgtggcttggtgttttgcattacttttggaaagttctcagtcattgtttctttacatatttcttctgctccatcctatgtttcttctcctactagtattctaattacatatatattgcatcttttgaaattgtcccacagttcttaattgttctgttctgcttttatcattcttttttctctttgaatttcagtttggaaagttttcattgatctatcttcaagctcactgattctttctttggctgtgtctaatccactaatgagcctatcagaggcattcttcatttctgttagtgtttttcatttctagcatttccttttgatacttttctagagtttccatctctctacttcattatccacctgttctttcatgtctattttttccattaattaccttaatatattaatcagttactttaaattccataataattacaacatatgtttcatatctgagtctagttcttaatattgttttgtctcttcagaatgtttttttcttgtcatttgacatgtcttataattttttgttgaaagtcagatacaatgtatcgagtactaggaagtgaagtaaataggcatttagtataagaattaatggtcgtctggcagagaagttcgtttgtctttagtgtttgctatagttgtatgttacaaatataaatatagccagaggtttcagatttctctagtgtctttttctttgtctcatctcttacctttgggcttccctaagtactccttcttagagagagtttgtgtcacctctttcagctgtgctgtattcccgctgatgtgatggtaaggtgcaggggaggagaagcattctctaattttattaataaatctcagtcttttaatggggctgtgtcttggggctataaccgttacaagctttctcctttggtaccgtcccttccccctgcctcctactccctttcctgtctgcagcctccccaacccatttcctggaagccatggtccttgttgactatggggatcttttgccccctataaagtagacagaaagtttggggggtgctttccactggaatatgactctggcaaagtattttctcttggagcataggcctttgttgcagacacatttcacaaagattactctcccccttctcttgccaaaaccttgaagagatcttgcagatcttcatcttgagaacctgtgaatttcctaaaggtaaagccaatgatggtatggggtccctgaggactggggacccctggaagtttctgactctcatgctagtctacactcctggtttatcaaaatttccatttgagtgttcctatgagtttatgcctcatgtggcttctgctccaggtgagcagatcttggctatatttccccagatttgggggtggcagtttgccctaaagccacaattctctcgtggttccaagaaatataattgattttccaagaaaaagtccagcttttttgttgtaagaataaaattatgatttccaaagtatttacatgtcagaacaggagccagatgtcccaagtcatttcctttacctgagagccttcaccagcttctaagcaagaaaaagaaaaatctataaataagccaccatctacttgttgctattagtaaaaccatttttgtgttattagtaaagaggaaggaaatgctgatgtattgacttctctatctgcccattctctatggaggaggaaagccagcagaaaagtgctgaaatatctttgaggcataaaaagctaagacataccatgatgcaggagtctagcaatctgtccagcagaaggctcagtctgactgtggccatcaggggtgtcttaggagggatccaggcctccacagattagaacaacctccagatatttcccacttctggctagttattgatatgctgtccacaaaatcatggcaactcataaaatcacaaaaatttgcatgttggaactggaagattctcagggcttttttctttttctttctttcttttttttttttttttaacaaatgaggaaactaagtcccagagagtctggttcaaagccatacagttagctcttgacagattgtggggtgggtggcgggggagtgggggcagtctacacttttatcaatgccttttgctttcactctaaattacttttattttcattttattctaccctttggagcataagatttctatgtacttgtatatatacttttctcattagtatgttggctccctaaggagggtataaactggccctttatgttattactaaattcccctaggcatttataacgatgaaaaatgtcaaaaaaaaagaaaaagaaaaagaaaaatatagcagtgctgaagatggggaaaaaaaggtaggctacacttatttatttcccttccaccttgtcatctaggcattttgcaagcatatcacaacagtatacatctgatatatctgctgtcacctccatcacccttccattccacctgagatcgtgttaggaaaagaaatgaggaagacgtttgtgttcttcttgctcattgtttcaaatgatgagaaagactttgatgagacagacagaaagaagaatgaggcaaagcaagaataataaacccaagtgcaatgataaaaccaagtgtgcagtgggaaaatatgcaagactaaatctaaatccttcaatgtgagtcatctgaggatacctttgaaaatggtatttttatttggtttgtctgaaacattatgtagcttttgtcctgtgcttggttatctcagagtcttagctgtcagagaaggaagggacctgagagcctgctttgtttaaagttcctcgtgctgcactggaatccattcaatcaccagggaccagctgacttctgctgaacccaaccccatccacacccacccccagtcctcaacccacttactttacattccaggggtttgggtgttagaaagtcctttctcttgtagaactgaatatgatttccttgtaaatccatgaattggtcttaattacatcataaaataaatatgcttgacaattcagctattaagcaaagtatacattttgtattacttagatgaagtctttctgaggagaaatcttggacaaaacttgacagtctattcttttattttcatggatctccaaacaatatgaaccaaaatggctagcctgagtgatttaaggggttcagcaaattgacctataaaaaaaacggaggccaaagtagtttgaaatataggacatagaaatgtctttacttctccccaagtagtgaatgatcacaggtccctgtggggtactcagggcaggaatatgcccccaatttgtggagatgaaggatcactttctcatctagagtggtaaattatattaattggagaaagtggtgaattatattaaaagaggcatttccagttccaactcttcagatacacatggaaatgggcagttgtgagtatatttagagacaccatgttgcactagacgttagagaacgcgagtgtcacgttaaatggtgataggtgagactgaaattagttatctgaacattctctttttcagaaagatactggaccttgcattagaaaaacctggaaaaagttacaaggtatggagacattattgatgtcaaacatgatttcagacaggctgtttgttctaacctcagccaaactccggccccaccggggaggcagcaagcagatagcaggaggaatgtggaagagagaaaggcttacggaaaatggaccaaagaggaaacaaggcagaagttctccatctcttttgattggggccaactatgagaagagatagccccagtgagaaaaagtgagctctaagctccagggatcagcagggagccatgaggggaaagttttagtacctgagctctgtgtatatacaagaaaatgcaaatacaaattgagcaccaagaaattacacatctatacgcagaagggataagaaaaaaaggcaaatttacaatgtgacatcactaattaaaagaattagggaggggcaagagggatcctactgtagtagatcccagactttttgagtttattaatttttaaaactagaatgttgagttcatttgtttaaaatattaaatgtaattcaaataatggtatcttagtgattattcaaaatcaaaattttatttgtcaaaaagaatgctgaaaaaggtcatattcaaaggaaataatgattatatgactaaagatagtaattaatttctcaggaaaaaaatgatccacccacacataaaatccttcatctttgtagaaacttatttgaggtaaccctattttgctcccttaagctcacctttgattgaacaaagtaaaaatagtctttctttgtctatgcatttactttaataaataggcatctagaaacatcagaggcaataatatatcaaaagctaactgaattccaccaagctgttttgaaaatgggatttctccatcttcgaattttcaaaagcaatttatctcctccacaggctgacaaaaaaggaaagtttttgatgccttactctgagggaaaatttcttgatttcaaatatgtaaggaaaagagttctctgcatattttatcttattgtatatatatatacatctatcactttgtttctttgtcaacctcatagccagaattactgactgatgatcatttgatgtaccacactaatttcagtgagagttgtactgagtgttttatctcataaatatgtttataatctctaataaactaggtatgcaatttcttagtgaattttcaatggtaatgcaaagctaaatatcaattaattaaagagttctgggggtggaaaaggggacaagggaaaggaaccactcttggttcttacaagatggaatttgcaagagaacttaaattacaaaggaaaaatggcattaaattaatatctaatttctaagctagttgaccaaattatttgaggcttattggcgttctcttgcttagtattgatatagtacttacttaacttgctatcaccataaacaaaaacaaacaatgatgacatgctcttcaaactgaaaagctgcaggtagcattccccaccttcaatagtagctgcctgaatctgtgtctctccatataacctttgaaatcaaaccgttcaatgaggatattaagaaatatcacccctaaccctcatgtacaacaaaactggaagacaaagaatagtttagactctaagtgtaatgggaagaacctctcaaaccagcagaatcagtttcagactcctgactaaagtctctctgatggacaaggatggaagaggtgtgactgcatttgaggatgtagcagggaggaaaagaaaaagcacccccccaagaagaataggggtggatctcaggagtgtactgagatgggacatagagaacagggacatgaggcctcagggatccactggctactgtggaattgaaagaaagaggcttgatgtttcaaaggaccataggtgtaagtcttctagtaaagaagcaggcaatgtggaggcttgctggtaaaggggaaaagatagcaaaagctagaagttataggaagaagtgttatacatcaggaagcactgtggccacctccacacggtagaagaaagcaacgaaaaaatataccccacttacaagggcaacaaaaaaatataaaatacttaaaataaatgttgtggccaggtgcggtggctcatgcctgtaatcctagcactttgggaggccaaggtgggcggatcacgaagtcaggagattgagaccagcctagccaatatggtgacatcctgtctctactaataataaaaatattagtcaggcatggtggtgcaagcttgtaatcccagctaatcgggaggctgaggcagaagaatcgcttgaccccaagaggtgaagttccggtgagccgagatcgcgccagtgtgctcagtctgggcgacagagcaagactctgtctttaaaaaaaaaaaaagttgcaagaaatgtggaaaaaaaactcatgaataagccttgaaaactctcctggaagacccatgatcaacttgaaccataaggaaaatgccccttgttcatggacagaacaagtcaacattataaacttgccaattttcccaaaaagaatgaataaacaatacaatcacaatgaaaatagcaagaagtttgttttttccccctcgagctagacattcgattctaaaattcacatgaaatataaagatgggataatagctaagaaactcctgaaaaggaagataaactgggtggggggcagccctaaccctatcaggtattaaaatatagcattgagctgctgcatttaaacgattctggaaatgttccatgaatagacagaccaatgaaacagaatagaaagtagatccaagtatataaaaaatttgtgtttgataaaggatgaatgcatcctttgttatacacagactttcatttgggaatgtataaatttgggggaataatgagctttcattaattactgtagaaattatgaactttcattatttattggggaaattatgaactttcttgtaaataatgttgaaacaattggtttcatttgtaagagaaaaacgtggacccatacttcacattatacttaagaggaaattctaaaagatctaatatataaatgtaaaattgaaaccacatagtactcagatgaaacaaaactttgaagggaagaaaatactcaaaatccagagacaataaaaataaaagaaagaattaataaattatattctctgtgtgtgtgtgtctgtatgttttaatataacaaatagaacaggaaaaataatcaaagctaaaataaaagaacatgttttcacctgaagaatttaaatctgtgaatcaaaatacttcatctattatcagttgactaaaaccatagacctggacacagttttgtaaaatttataaaagctcactccccaagtatttcagcagaaaagtcaatctacctacaatttaataaaaataatatttgtctcagacttttccatagcaatgaacatcagatataaataaaagtaacatttacagagatttaaaaaagaaagattgtaacccaagaatataaactaaacaaattttcactcatctgtaaaggtcaaagtaaatagtcaagtctttaggaagtagttcacttccatgccattttggagaaaaataaaaaaataataattgaatatgtagtacatcagagcaaagtaaaaaacttggtaatatgaaaattgtggtaaataaagaacattcaggttcatttttaaaagttgcaattattgaaaatactcttgaaaccatagggtaaatattttgaaaatgctcctgaaaaagaagagtctccagtctttccctctgtctctcacaacacacagccacaaacacacttacgcacttttaaaatattagattattacaaccaaagttaaaaattagctggagaagaaggccaaggaataaaaagcagccagtttcctaattttctataaagaagcatcaatagaaactgttttatgttggcaatactaattagataaatattggttcaagtgcatgttctcagatttgaagaaacttatcagataattaaaaacaaaatatacctctttctagttattagaagtacaaagacattaaaaataatcaacttacaaaaagcggaaacaagaaaataaaagcacacaagcaggaaaataaaggtatgaaatgctaactccctaaagtctattattttctcatctataaaatgtgggttataacaaacctaaccataggttaattttgaagattaataagataatgttcaaaaagtatttctcagtgtctggctcacaatcgaagctcaaataatgtttattattactatttataataaaatatgacagttatcaattatgaaagtaaattttcatagttaaaatttaaataaaatattaaacctttcttattaaagggaaaaattaatacaataaataaaataacaaagagaattaaaaatttaggcttgtgaaaaggtatctcaaacaacacaaatcaaaagaaagtaacagtgtagaattccaagtaaaaaagcattagatgatgcaaagatggtcattttatatggatacatttttaaaaatcacagtgatgataaaattgtcataaaatttaattaattaaacatttatctttacaataaataaaagtatttggaaatacaagggataagaaataatttttaatgctttgctctcagtatttataaatcaagaagaccaaaaatagggcaaccctcttttgggccccctgtccgtggtggagagctttcttcaattgttcattaaactcttgctccaacctcaaaaaaaaaaaaaaaaaaaaagaagaagaagaagaaataatataaatcaagatgaccaaaaatatacctaagatggtagaggactttaataatgtaattaattagatttaattagtgtatattaaacaatatacctttccaaggttttggaaaaccttaacaaaaactatatcttatgtagtctacaggatttaaaaaaattttatttgtatatgacacactctatcatgactatgtaataaaaataaaaactaatgggaataaaacatttcaaaaaatccagtaattttagaataaaaagaaaacattgtaaatattagctaaaaagaaaaagaaaatgaaagttactactacaaaccatttagaaagtaatgaccatgtaaaactatatgttaaaatttctgtaccaagacaattaaatgggaaaagaaaaggcctttcagcaagtggagctggaagaactagatagccacacaagagagaatgagttgaagtcctatctcacatacaaaaattagcaaaatggaggagctaaaactctaaaactgttagaagaaaataagcataaatcctcatgatcttagaatagacaatggtttcctagataagacatcgaaagtataagctgcaaaagaaaaaaatacaaaaattggacatcatcaaaattaaaaacttatgtgtttcaaagaatgccatcaagaaagtgaaaggaaaatccacataatgggagaaaatttttacaaatcatgtatcttataaagcaggggtccccaagccccagaccacagactgtaccagtccctggcctgttaggaaccaggctgcacagcaggagatgagttgagggaagtgagcattactgcctgggctctgcctcctgtcagatcagcagcggcattagattctcatggaagtgcaaaccctattgcgaactgtgcctgcaaggtgtattagtccattctcatgctgctatgaaaaaatacctgagactgggtaatttataaagtaaagaggtttaattgactcacagttcggcatggctggggaggtctcaggaaacttacaatcaatggctggggaggtctcaggaaacttacaatcatggtggaaggcaaaggagaagcaggcaccttcttcacagggcagcaggatggagtgagtgcaagcaggggaaatgccagacacttataaaaccatcagatctcatgagaactcacttactatcacaagaacagcttgggggaaaccacccccatgatccaattacctccaccgggtcttacccttgacacatggggattacagagattatgtgaattataattccagatgagattttgggtgggggcacagccaaaccatatcatgaggaatcaaggttgcacactctttatgagaccccaatgtttgatgatctgaggtgcaacggtttcatccctaaaccgtgcccctccccctgcgcttcccaccccctgttccaattttgtgaaaaatatctttcatgaaactggtctctggtgtcaaaaatgttggcgaccactgttacaagggactcgtacctagaatatgtaaagaattattacaactcaataatagaagggtaaataactcacttttaaaaattagcaaaggatttgaatagacagttcttttaaggagatatacaaatggccaataagcacatcaaggattgcttgacatcatcagccatctgcaaaatcgaaatcaaatccacaatgagataccacttcacacctgtgacgatgcctataacaaaaaagatggataaaaacaggtgttggcaagaatacggatggagaaactggaatcctcatacactgctgctatgaatgtaaaatggtgcagccactttggaaaacagggtggcaattccactcccaggtatataccaagagaaatgaaaacatacatccacacgaaaccttgtatacaaatggccatagtagcattgttcataatagccaaaaagtggaaactacccaaatattcatgaactgatgaatggatttaaaaatgtggtatattcttataatgaaacatgcttccgtgataaaaaaaaaaaaaaaagaaatgaagtgctgacatgtgctacagctgagacaaatcttgaagacatgaagctaagtgaaagaagccagtcacaaagaaccccatatggtatgattctgtttatattaaatttccaaaataaaggaatttatataaaatgaagtagattaatgcttgccttgggctacaggggctggagcaattgagggtgatttttaaggggtgcaaggtttatttgtattgtcatgaaaatgttctaaaattgattgttgtaattgcagaactctgtgaatatactaaaagtcattgaatcatatactttaaatgggtggattgtgtcacatatgaattatttctcaatagagctgtttaaaaaaaaaaaaacaacttgttggccgggcgcagtggctcacacctgtaatcctagcactttgggaggccaaggcgggcggatcacgaggtcagaagatcgagaccatcttggctaacacggtgaaacaccatctctactaaaaatacaaaaaaaaaaataaaaaatagccaggcgttgtggcaggcgcctgtagtcccagctactcaggaggctaaggcaggagaatgacatgaacccaggaggcggagcttgcagtgagccaagattgcgccactgcagtccagcctgggctacagagtgagactccctctcaaaaaaaaaaaaaaaaaaaaaaaaaaaaaaaacaacttgtactatgacttcaacttccaagtggaatgtagatgttgtgattgcccaatgttcccaacacaattactggacaaaaagccagacaaatgaccaaaatcttgtttcaagtcgccatacagttgtagaaacaataattagatgaactggaatttcacaggaggagacttctagaacagtaggaattttgctaatgtttagtaaggcctcatgatcagatttggcccacaccagggagagaaaccggagatgtttttgttggtcactcagggctggtatgggcgcaaaagattatataacttgagaagcacagacttaataggtgttttccccaagaaattctctgtgtgctggagatgaacatggaggactcgagagctaggctaagggttcctaaaagacagagtaaaatctgctttattctccaagtgcttgagagactgtatttccccagagggactgggcctaccaactagtcctccaagatgtttgccacatttaaagctgcaggatatgggagctaaagatccaagctcaaatctagaacagtaggaattttgctaatgtttagtaaggcctcatgatcagatttggcccacaccagggagagaaaccggagatgtttttgttggtcactcagggctggtatgggcgcaaaagattatataacttgagaagcacagacttaataggtgttttccccaagaaattctctgtgtgctggagatgaacatggaggactcgagagctaggctaagggttcctaaaagacagagtaaaatctgctttattctccaagtgcttgagagactgtatttccccagagggactgggcctaccaactagtcctccaagatgtttgccacatttaaagctgcaggatatgggagctaaagatccaagctcaaatctagatagtggatttgccacagtcttccatgtttgagggagagtgacccactagtctctcagcccaaatccttgaagggtcttccttgagaaacagggaaggaccaaagatggatgagtcttaggaaaactgcatatgtgtaatagaactaagaggggaagcgggagagagacaatgggccaaaagcaacaactgaagatataatggcaaagcatttgccaaaatggataaaatattaatacatcaattcaaaaattcaagaaaccctaagtagctcagcaaaccccaagtagggtttaagaaaaaagaaaatcatactaaggtacattacagttaaactgctaaaacttagcagatgagctcaagtttcttttctgaagcaaattcatatccttaaatagccttattaaataataaatatttaaaaattttaaaactacttattcatcataagaaattaagaaaataataaaatctaagattcacaggagattgggttaccaaaaataaatgctgaaattaaattatcaaaaaaagggaaaacagttaaattgataaattaataaatcttaaaggtggttattttaataataaaaacccaacaaaagacgtgtatttactttcaatgtttattattttaattaaataaatttgattcaaattaaaaagcacaaatgtgagagtgaaaaaatgacatgactacagattcaaaggaaactacaaaaataagagaaactgcaaaaatatgccttccataaataaatttgatagttttaatgaaaagtataatttctggccaaatataaattataatattttacttaagaagtagaatatctgaataggcctattactatgcatattactaaaaggattattcagaaattttaaaatttactacaagattttacaagattaggttgtatcacataaaattactttatgctatatataatagagtacatatgcataataattggctatatttgaatctcaatttatttttgacattaaattaacttgttaccaagcttgagaaagcactacaaccatgcaactaaaaaaatagcacatgcgacactctcacttatgaatataggtgcaaaaattctaaaggaaattctaacaaatcaatttcaatgctaaataaaaataaggccataccattttaagtagaattattctaggtatgcagacttacttcacactaggcaatctatcagttgaattgatatagctacagttcaaagggaaaactacacaattatttctacccatgctgaaaacacattaataattaagatacatttaaaaattaataagctttatgttttagagtagttttagctttacagatatattgagtagaaaatacaaagttcccatatactccctctccctaccacagtttcctctattatcaatatcttgcattgatgtggcacatttattataattgatgagccaatattgatacactattattaactaaaatcaataggttactttaggtttcactcttggtattgtacattctagggattttgacaagtgtatagtgatgagtacccaccactaaagtatcttatgtaataatagtttcactgccttaaaaatcccccttgtactacctattcatctctccctgtcctccagtccccagcaaccactcatctttttactgtctccaaagttttgccttttccaaaacgtcatagagtaggaatcatacaatatgtagccttttcagattggcttctttcacttaacaacatgtgtttaaggctcctccatgtctttttgtggcttgacaactcatttcttttcattactaaatagtattccattgtatggatgtggatgtaccatagtttatttgtccagtcacctattaaaacacatctgggttgcttctaaatgtcggtagttaagaggaaagctgctgtaaacattcatgtccaggtttttttttctgtatgtaagtttctaattcatatgggtaaatatgagggagtgttactactgagtaggagtatgcctaattttgtaagaaactgccaaaatcactttccaagtggccataccattttgcattcccactagcaatgagtaagaggatctgctgcacaacattctcatcagcatttggtggtgtttatgtttgggattttggtcattctaatgggtgtgtagtaatatctcgttttaatttgaaagtctctaatgatgttgagcatctttccacaagcttattttccatctgtatatcttctttggtaaggtatctgttgagatcttttgcctattttttaattggactgtttgtttcttactattgagttttaagagttctttgtatatcttaaatactagcctgcatctgacatgtgtttcacaaaatcctcccagtctatggcttattttttcattctctgaacagtgtcatttacagaacagaagtttgaaattttaacaaagtccaacttatcaatttttttatggattgtgcttttggatttaagaagtcattgccaaattcaaggtcattgaaatattctcctattttaccttctcagcattttacaagatatatttttaattaaaaacaaatagatgctctgaatcagtcatggtccccacaaggatttttaatagaaactgtaaggaaaagacaacttacaatgggcttggtaaggttaaggaaatatataagggataatgcttgcaaccatgataagctgtcatcacccaggtcaaaaggaaaaaagggaggagctagtgctgggacccagtgtggaggctatggtgaagaagctattattgtgaactccactactactataggtttcatacctaggcaagaagagcatgtagtcctcataagttgatagatataagaaagggggctgggcgcggtggctcacgcctgtaatcccagcactatgggaggctgaggctagcggatcatgaggtcaggagatcgagaccatcctggctaacacggtgaaaccccgtctctactaaaaatacaaaaaaaaaaaaaatagccaggcgtggtggcaggcacctgtagtcccagctactcgggaggctgaggcaggagaatggcgtgaacccgggaggcggagcttgcagtgggtcgagatcgcgccactgccctccagcctgggcagtgagagcaagactccgtctcaaaacgaaaaaaaaaaaaaggagccctaactggcaggaacaggagcaaggatgggggagagccatcattctaagaaatggctgacaagccatcgttctgagaactggttaaccaacaacaacccacttgcacaacaccctgttcccaaataccttgttttgcacatagacccagcagcatgaccttatcagcacgtaccctctccagcacaagcctataaaacttccctccagcccctgactcttcgagacaacctcctctctgctgtgcacctcattgttctcttgcagtgtatcttcgtactttctacaataaatctgcctttctttatccatgactgtcttggtaaattctttcactgcctgcaatgctggacccagccagtcacaccagcagcattttggtggtccatatggagacctctcccctgttcactgttttttctcttctccaactccaacctcttagtggacagcatccaagcctggagacatctgatggccccccactgcagctactccctggtggatcagaaggtcccagtggaaagaagtttgaccgtcactgcccgatcgagtgagagtttagagtttactttcctttcccgtcttctggtggacaaactctagtatccctctagcagctgatggccactggccagggccattccctggtgtggcctaaaggccaaggagtgaaccaggtttggctgccttgcttggaagggaggatggctctctcctaacccttctggtcaaaagtccccagtccctacatgcagcacaataggcagcggcagcttgaccagggcaaacgcacacacattttggggaactcagaccccgtccttctcactctaaatttctcctgtgaagaaagccagccatccttttctggacattttaagcaacatgatcccaaatagcaccagaacagtgagccttccctcaacctttgccccttatacctggattcagcacccagtataattcatacgtggactgacctggggctgctcaccctgtgttcatccatccagtgtaaggctctcatgctgggaggtcctttctaataggtgggatgcccctttggaaagtgcctctcaaggctcctcagtggacataagtggaaccccctttccttggctggaggccccaagagaaattgtggtttgtgtccccagtagacattattttccaatccccccatgggacaaagcccttccattctctcagactcaccgatgggctgcattctaaaacattgggataaacttgactcccagactctcaaaaggaaacatcgaattttcttgtgtaatacagcatggccactttataaacttccagatcaggaatcctactggcttccaaatgggacctctgcccccagtagtattttataggttgacctctttggtcataattcttctaaacggcttgagattccttatatctgaggttgtgtaactctttctaagtttgctctcctctcccttacatggttccttcctttactaggacagctgcatttatacttctacttctcctcttcagtcctttgtctctttaatttactggttaaatttgtttcttccagaatgtagcaattccacagcaaactcctaatgatgcaaggatatcagccaatcaccctcagaaaaccccatgaatctcctctagactcactagatatcaattccatattaacacgctctttcttcctgagttctatcctccagcagcatttaatagactaagtcccataactcaggacaataacccacagggtcccctaacagaccaataatcacaggtagggcccacactgtgcccacagtcagcaggaagcagttggaagataagacctccataccaatgccaaagatttgtcattgttgttctgtcagcggggaacatggagtcctggtaagttaatagatacaagaaaagggctctagctggcaggaacaggaatgaggattggggagagccactgttctaagagatggctgacaagccatttttctgagaaacacctaaccacaaacaacctacttgcacaacatcctgttcccaaataccttgttccacaggtagccccagcagcatgaccctatctgtacatagcctctccagcataaccttatcaaacttctctgctgtgctgcctgttgctctcttgtatctttgtactttctctaacaaatctgactttcttaacccacaactgtcttggtaaattcctttactgcctgtaacaccagccccagcctatcacacctgtgacagatggagaggatgaagtacctttacttctctctcctcaccctcaatagcatgccagtgatccttgctggccaaacacaatcagagggcagccagcaagggagcctgggggctgctgtctgcatgggtgatcatcctggggcacaggcagagccaacatgagtaggctatccctgtgagagagggcacatggagcatgaggaccacagctctttgtgtaaccaaaaattagtgttccacactctagactcttgcagaccaagggttgaagctgagctctagcactcattggaaagttgatgtctttaagcctctgcattttatgtgtaattaggattaataacagtgctacattatagatattaagatgactatttatattaaatgtttgtgaagtattaatgagtgcttagtaaatgctagctgctatcactactgctgccactactatcaaaactactaccattactactactaataacataactactattgtcactactattaccactaccattagtactaccaccactatcatcactaccatcactactaatactatcattaccactactattaccattaccacgactatcattactactactaccacctccaccattactactactaatgctatcattactactactgcttctataattactactcctactcctaccattactactactagtagtatcaccattactactactactatcattactattaccaccaccattactactatcattactactactaccaccaccattactactactgctgtcattactactactgctactatttactcctaccgttactactactaccaccaccaccattactactactatcattgctactattactactgccatcattactattactactattagtttagtcattattatcagaggcgaggagaagcaggcagcataaccaagaacataagtattatttctcaatatgagacagaatctctatattaaattaatagccaaagccatacccaggaatgaaatatttacatgttctcactgaaaccaagaaccaaataaccagaggattgctaccatcattatcattgaatgttctagaaattttagccaacatattaagatatgcaacattaggaaagagaaaaagtttaccttttttggttaacatttacaaaatatgatggttctctgccaagaaaatcactccccaatttaaaaattaagtggctaaacacaaaatgaatgtataaaatttaacggttgttctgaaaactaggataaaactattcataatatttaatgaagataattttccacttacaatagcaacacaaactattaagtgcctacatagctttatatataattttgcaaacaatataaaggctagtaaaaaataaaaacaaaaaacttataactacattaagaaaactgggcacagtggctcatgctggtaatctcagaactttgggaggctgaggcaggaggatcgtttgaggccaggagttggagactagcctgggcatcattgcaagatcacatttttacaaaaaaaaaaaaaaaataggcacgcatagaggcatgtgcctgtagtctgtttacttgggaggctacaggtagctagactacagtaatggtagtagtagtcatggtagtagtagcaaaaatgacattggaaaaatgtcgattttttccaaattcatttataggattaacacaattgcacttaaacttccactgagatttattattaaatgtgttcaagtaaaactaagattcatctagaagaatgaatttataagtagagctcagaaaaaattttttaaatgcaaaacagaaaagattaaccagtgagatttgccctgttatatatagaaacataacactaatatagacaaaatatgtggttttggcacaagaatagattattggaacaatgaaatgaaacagaaactctgggaaaagaatacctacattaatataatgaagtaaacccagacatgtattctgacacattacccccaaagaaataccaggtggattaaatatttaaatgtcaaaaataagccaccataaaaatcttagaagaatatgcagcagaatatttgtgtatctcacagtgaaaagagggttttacaagtataaaggtaatacaaaatagaacagaaaattgatatgacaacatgaaagaaaaccttttatatttcaaaagtcagctttcagtttttcccagtaacagccattgtttataaccttggggtctaagtttccaggcttgtattggaacaggattagaaaaggaattatactatacattgggtgactgtgtcatcaccctctaggatgatttcttcttggaatgagacttaagataccatagttctactttcattgtgcattgatacattaagtcatttataacatttcccaaaactccaatctggagaactttctctatcaccagggcattgctttggaattcagggaggcctgagttctggatgggaatgggagtgagatggtccagtgaatgttaacagtcactattattatccttattttacagaggaggaatattctgctcctttatgagccaacatttactttctctgaattaaatgttactggtttcttatttatagacagcagagattgactgggcacactttcccccacagtttccaagactctgtaattatatgcaaaatagtaaaattaaattcaatctagatgaatccatatttcaataaggatattagtgacttaggtctaaaaattaaaattagactcgtcaatcctgttatgctttccattcaaatgtttttcctaaacagcaacaacaacaaaaacctgatttcctaatagtccatttagcttttatttcatgccatttacaaagtttaggcaacataaatgcactttatgcatatctctgtcccatatctcagtctagatagttgtctagataattttctagacaacctagataatcaatgggaaggctgaatggcagagcagaaaaaccatgtcttcagggtctgaactattgagagtaagtatcatctccaccacttaacaactgtacaactctgggaagatgtgctgggcaagccctttcagtcttgttggcttacccagtagtcaggatttgttgcaagaatacagtgccagctgtgttccagccactgctctcagggtactgttccctttccctttatatgttctgatatttctcccatagctaccaaccagcccattcttccagtctttctctgttcagatgctaatgggagagagttgatggtcttagatagtcaccataatccctttagagcagagatttgttgtagaagccaggccactttgaaggacacaggctgcctgatattctggctgcccttgggtcagatctcatccctggccaaagtggtgccaccactttctcaatgattgcttatttctccctccttcaacatgctttagaaggcagcgtttcccttagaggagcacagtgggctgggcagcaacagtggatgacgtgcgtattacggcactgctgggtatcatcataaccaacatgaacttgtggcttgttcttacaatgcgccagacgtctcatgaaacattcaacgtttcttaattcaccctcacaaccagaatgaggtaagtgttgttcttattcttattatttgatattttatagataaagagaagcttacagcatgaaataactttctcaaaatgataagatcagtaagcggaatattcttttttgtttttttttttgagacggtgtctcgctctgttgcccaggctggggtgcagtggcccgatctcggctcactgcaagatctgcctcccgggttcacgccattctcctgcctcagcctccccagtagctggaactacaggcacctgccaccactcccggctaattttttgtatttttagtagagatgggatttcaccgtgttagccaggatgatctggatttcctgacctcgtgatccgcccgcctcggcctcccaaagtgctgagattacaggtgtgagccaccctgcccggccagtaagcggaatattcaattggattccagagtttatgcttttagctatcaagctatactctttctcactatatttccctgagctttggtttccttatctataaaactggaaccgcactgcctgtttgcctttagagctataggtaataaatgttatgcatttattatggtaaataacatgtagtagagcaaagcatggaaattcaggaagtaacaaagagcagtcataagaatgtctatgtggtaaatctagataaaaattacttgtatacacatttacagtagcgcctttaaaacacacaccgatagcactttagtaagtcaagaatgcatgttgcaccaattagagaaaacaccaattttttaaaaaaacatataaataacaagctaatagaagaagaaatgtaattagaaaaatttaaataagcccaaaaactttaaggaaggacaaaaaaaatcatagaacagagaaaataggaatcaatggtaagatggtagatttaaccttgaattacagtaaatataaacagactaaatattgaaattgaaatataaagctcatcagagaaggtaataatatcaagcaaagctaaacaagctgcttactttaaatataaagatatcgacaggttgaaagtaagtaagggatggtaaaactactatgcaaagcaaaagttacaaaaccaaagcaaagactggctcgtttcagaataatcaacgtttcaggtttaatatgaaataatcgtaaatttgtttatacctaataacatagccataaaataaaaattgacagataaacaatcatgttaagagcctgtataagccagatttctccagaaaaacagaatcaaaaggatatatacattaagaattatattaagaaatttattttagcatattggcttacatgattgtggggctggcaagtccagaatccgtaggagaagctggcaggctgaaactcaggcaggaaacgatgttgcagactttaggcagaattttttcttctctaggaaaattcagtttttgctcttaaggcttctgattgtataaggcccattcacagtatgaaaagtaagatttatgtaaagccaactgattgtagatgttaactacatctacaaaatacctttgcagcactacctagattagtgtttgattaaataaatgggcagtaaaggccgggtgcagtggctcacgcctgtaatcccagcactttgggaggccgaggcaggaagatcacttgaggtcaggagttcaagaccagcctggccaacatggtgaaaccccatccgtactaaaaatacaaaaattagcctggcttggtggcgggcacctgtaatcccagctacttgggaggctgaagcaggagaatcacttgaacccaggaggttgtagtgaaccgagatcgcgccactgcattccagtctgggtgacaagagcaaaactctgtctcaccacaaaaaaaaaaaaaaaaaaaaaaaaaaaaaggcactaaagcctggcccccatgatgacacaggaaactaatcgtcatggagactttatccacacttttgaatatatgttacatttcaacattaaaacacacacacacacacaaaatcataaagcaatcaacaaaattaagctgaatgcttcgtaattgctggattccctgggaagctgactctgagatggagattagcgtgcaggacatttcttacgggttgttcttgggatcaatacctgtggagaggagaagctgaggcaggatcaggaagcggggaagtagagtgcaatgctggtgaagcggcatcactgtctggggtaaatatccggggttcatcatctctcgtcaagatgattaacgacatggacacacatgggtgagttaagaagcggaaagtttaataggcggaagaaaagagtgaggagaccagctctcagacatccttaagggaaaggctggcccgtgactg

SEQ ID NO: 1010 - DNA, 35062 bp, Homo sapiens
gtagcgcgcagggaaggctggtcaccccaccctaatcttgttatgcaaataggcttcccacttggcaggggccgtcttgtccactcgtttctgtaaacatgggtggcaaaaagagaagatggagctgccatttagaacatgcctaatcccaggtagtgttttttgttgttgttgttgctgctgttgtcgctttttgagtcggagtttcgctcttgttgcccaggctggagtgcaatggcgccatcttggctcaccacagcctccgcctcctaagttcaggcgattctcctgcctcagcctcctgagtagctgggattacaggcgtgagccacagcgccggccccaggtagtatatttttattggcacaactgccggtatttgcctgtgcaagctttcagcttgcttgtctgtgtctgcagctcgattttccaggttgctttttgttagaaaagaaaatgatttgggggctgcttttcattaaaaggaagaccttactgaggactcccataccttcactatctgcctaagtactttcttcttaactcctatatcactgggtcagcagcaaccccagtcaaacctcaagggagacgggaagatgggacgatctgtcagaggtatgctgagttgaggcaagagagctgacctttatggattgccaatcagtgactcattggaagtggggcaacctggaaggaaatgtggccttaggtgaggcagctgtcttcagaggaggcaatttctttgtatctggaggggcaattgttagtgttcccctggactgaagggtgaattatggagaatggaatagaacgatttgttactatgatttggttgatgacttatttcctgtttccttagcttcatcttgctgagcaaaaatgaaggagcctggacccaactttgttactgtgagaaagggtcttcattcattcaagatggcatttgttaagcacctactgtgagtagatgatctcctgtcaaagacagttaacaaatcctcggaatattgcttcatgtacagttattggagatgagtaacttacattctcttaattgtaatggttccttggaaagtcatcgtggaaaatgaaggctggctcatacattttcccagacaggaatttggctgccaacagggaattctaaacaactaaaaactccagatgatgaatgcacaacataatgatggttaaattaaaaaaaaaaaagagcacggtaataaaatttccatgaaatattttgtgtaagcgcagataatcagtcattttctttatagaattcttattcgtaaataatttagaatactttgttctttataatatatgatgggcaactatagtatgattcttctgagtgactcagttcttttttttttttcacatttaatgactttgtttctcctaagtgaatgcacagatagtatattaatcagggttctctggaaaaaccagaaccaatttattatcaggtactggttcatgtgattgtggaggctgagaagccccatgatctgctctctgcaagctggagacccaggaaagctgatgaaagtcaaaggcctaagagctggagggccgatggtatagattgcagcccaggtctaaaggcctgagaaccagaagcacagagggcagaagatcaatattccagctcaatcaggcaaagagaaaaagtcctcccttcctctccgtttttcttctattctgaccctggatggactggatgaggcccagccacattgaggagagccatctgctttaatcagtccaccaactcagatcctgatctcttccagaaacaccttcacagatacacccagaaataacattcaacctgttaggagtatcccatggctcagtcaagttgacacacaaaactaaccatcacagatacacatcaaagttaaataatattaacacagactttggcaagctgtattttaaaacacagtaggttagtgagtctggtttaagagcactagatgaaaccacatataaggatgtttttgacattctgtgtctgacccttcagactccctgccctcctccccaccatgttctgaaccccagaacactgacctctacgaacagccccacatgggctctgttaccctctggcttcccattggcccatggaggcacagaggaagttggggcaggaggacagaatggttgaggtacggatgctcgagctctcaaggccacaagtcggcaggggctacattcctgtgtgaagctcactacccctcagtcgtctcctctagctctctgtggggtccggtgacctctctccttacagtcccattagccctaggggaggtaatggctctccagggagtgctgcccatgggtgtctcagtatcacttgttggttcccatagccccacccacacctgtgtaaataggccttcattaaccttagctcagttgcctggtttgagtgtaccatctgtttcctgccagcactctgactgataacagcatttttgatataggtctccatcacatgtatgtacctttgtgtcctctgtattcctcattgatcagggttataaattttctcttcctgtgacactaaattgcccttaataaagcttattgaccctaaaagtcaaagggggcaaaatcagagctagtctcaattccttaaagtggacattatacagaaggttaggaaatattaaatacaagtattcacatatgtgttccccccgtcaagctaataaacatatgtatgtgctttttgaaaaccagtgtaaccgcaggttgtctcttgttcctagtaggtgctgattagagcaatgagttccaacttggcagtttttggaaactgaacatgagctgttaatgtctctgcatcaactcgggtttccttttgcttttgtttaaattgaagtttttcacttaatataagatttagagatttctgtctcagagctcgccaagatttgctacttttgtctacccttgtttttaatcttaaaaatttggatttacttaataattccaagtatgaacattaatgttgcttttatcttccattttactgcacaggaggaggggaacagataccaaactactgattattttacttccattgttaatacacatgagaatataagtcttcttgtgtacctggaacttacaaaaattggtttcagctactcaggaggctgaggcaggagaatggcgtgaactcaggaggcggagcttgcagtgagccaagatcgcaccactacactccagcctgggagacagagcgagactccgtctcaaaaaaaaaaggaaaaaaaattggtttttaaaaaattacataacatatgtaatttttaaaacatatgttttaaacatatgtaattttcaaaaaaaaattggtttttaaaaaattacataacatacttatgttaaaatatacataacataaagtgtatcattttaaccattttttaagtgtacagcctaatggcattaagtacatttgcattgttgtgcagctatccctaccatccacctccagaacctttttttatcctccaaaattggaactgtgtacccattacacaataatgccccgttctcttttcctgtaagcccctggcacccaccattctgctttgcctctaggaatttgactactctaggtacttcacataggtagaatcatgcggtatttgtccttttgtgactggcttattccacttaccataatgtcttcaaggttcatccatgttgtattaatagcatgtcttggaattcctttccgaaatttctaaggctgaataatattccattgtatgaacagaccacatattgtttttctgttcatctgttgatgcaaacttgggttgcttctaccttttggctgttgtgaataatactgctgtgaatataggtgtacaagtatttattcaatctttgcttgcagttctttgagctatatatgcaaaaaatgggatcctggattatacagcaattctatgtttaattctgtggaaccaccatattcttttctgtggtggctgcaccattttatattcccaatagcagtgcgcagaagtttttccacatccttgatagcacttgttattttctgttttttgttttgttctgatttatcttttgacatggaacattcttatacatggttacacatccattatggtggtcttcatcaagttagaggctgcaaagcatccatatcattcattcttctagggttaaaggcatttgtaaaatatcaaattcaataacactgctaaatgtcttaaactttgtgtgtgggagggcgtaactactggattttataagtgcttattacacttgaagatgacagatttcttttctattgaacattttaaagaacaatttagttcatcccaactgatattttctgaaggccgctatgtaccaggttctgttacaggtgaatggacccatcagtgaacaaaaccttaaaaaaattacaaatcatttggaaatccactattacagtggcttcttcagggatgatactgttttccaatatgctacctaggaaatgtgcttctttccaaactcactgttatgtctcaagcgattagttcatggctcagaagaaacataagtgagaggtgctccttctacagcccttactttgtgcttgtttctggcactcaccactttcgaccttgtcattcgtgtgcttgttttattttcttacaagactttgagtttcttgacaggatttcatctgtatttgattttctacaattatctgcagcattttgcatataagcattaaaaagatttatttcatttgctgaataataatgaacatggctgttttgtattctttttatgagatggtcagtcacatgcagccacggaggagacacaggggaggctcaggaagacagagtattatactcacaggtcctacaaagaggaggcacgccatgccacgcaggaccacacgggaaaaaacaccagagtggtcaggaggcaggaggcaggagctcaggaaatcattcaacctttactgaggtttcgcgggaaaggcaggtgagcagcttaggatgggctagtttgaatcatcctggtgggctctaagctctagggatggccctagttgtctagtacccagctctggaatggttaaggcagaaattttaaaaaatgaaaatttaaaaaatatatatgtgtacaatatcatacacacatatatacaaaataatacacatatatattgtgtttgtgtgtacacacacacacacacacacacacacgtgacaacttcatgctagggagaatggtgattctagacatcctgaactccagaatgatggtgaaataggtaatgcaagtcacctccccacctgctcctgactcggtcggctccctcggtgggtgagagggttgttggtctgccctttggcgccctctaggtgagaacactgcataggccattctggtctcattgctgcagtttgtacttttcataggaaaaaattagcaagctgacctctgttttggaatgcctcagaagctagaatagaagcccactcactctcctacagcacccctttatccccacacacctgtctttgctaggtaataagcagatgcggcttgcagacacaaagcgtgaatacgattagtaaattcaccttgtgaaatgcagctccaccttcctctaatttggccttaggggttgttttgctatttttatgagtctgtatgtaattagccacaattaaaatctgaagtctctaagtattttcacagtccaatttcatctgaggcaatgaaaaataaataactcacagtgactttattacttctgtttctcagatttggggaagcagaatagtgaagtgggtctcttcacacatccacaggacaggtaggattcgcaggggcttgaaagtcccataactcaagtgcatttcacctgtactgtcaacactgtctatgggcaagacttaaggcagcaacgtccagcaattctttgtgtgcgaggatctcatttcatccttcttccagggaggagaggggtgagaaaaaatgactcccaaacctcttgttaccatcctgtctccacttctgagctctgtcattgtttatgtcatttgtattccagattccaaaaggatatgaaagatctgcctgagatctagtagcatatttccagctggctcttgggaatcaagaatatatacaaagcattgttgacaacaaatgtttatttactctgaagatggtttccccttctgtgtgagtcagggttctgcagagaaacagaaccaatgggatatacatagtgctgtggtttgaatgtgtcccctccaaatttcatgttgaaacttaatccgtattgaggtgatattaaaaagtggagccttttgggaagtgattaagccatgatggctccaccatcatgaatagatgagtgccttataaaagggctggaaagaaatggattaggcccttttgcccttcagccttctgtcacataaggataccatcaaaaaacaccactgatggagcattccctcactagatatggaaccagccagccttgatcttggactttccggactccagacctgtgggaaataaacattctggtctttataaactacctcgtcttaggtgttttgttagagcagcacaaacagacaggacagaaatacatgtaggaggagactggcttatttgattacagagagcaaggagtcccaccatctgctatctgcaagctggagaaccaggaaagctgagggttcaatttagtctgagtctgaaggcttggcaaccaagggagctgctggtctaagtcccggagtccaaaggcccagaaccagtagctctgatgtctgggggccgaggaagatgaatggaccagttcaaaaagagagagacagagaagtcctcctccctccacttttttggtctattcagaccctcaatcaattagatgatgcctgtccacactggtgatggtggatcttctgattcaaatgtgaatctctttaaccatcatagcttctaagttcccacctttcttccatccttgccccatcccttcttctctaacctcaccttgtcctcccttacctctatcctttcctctctctcctgcatacattttgtggaaagcctatgtattaagggtagacacaaggcaaaattgtttctctgttcatggaacttagatactactgcaccagctactggagaaagtattatgcacttgccaagtaatacacaggatttttgtcacttataaacacaacaaagctcaaaatctaccatcatcatattctccttcttgtcactcaaagtcacatcaagaggatgaattgattttgtcctcaggacaccttgtcatgtctcccaactttcctatataactgatggttgttactccagacttttattagattatcttcagtgttgtgggttgaaatgcatcttccaaaagatatgttcaagtcctaaccctgggaatgggaccttatttggaaatagggtctttgtagatatcatcaagtaatgaggtcttactggagtagggtgagccctaatgcaatgactggtatatttataagaagaggaagatttagacacagacacacagggggagaaggccatgtgatgattgaagcagagttggagtgtctacaagtcaagcaatgccagcaatcaccagaagctaggcgggaggcacccaacagactctccctcacaccccccagaaggaaccaaccctgcaaatgctttcatatagaaggcctctccagaactgtgaaggactttctcctgtttcaagccacccagttagtggtgatttgttaaggcagccctaggaaactggtacacccagtcagtgcaataactttcaaatagttctgcttgcctccaacactcacactccatgtgttcccatccttgattactgtggcattctgcacatggcactcaaagctgggtcaatgtgagccaagagaactcaggaaaggagagacataagagagaagaagaccctggagagagaggttttgagactggaaagtaatcatataagccattggatacttgcagaaatcttggggtggtcgctgaacttcccccagagcatgggatgggggaattcaaaggacagagaggcttctgttgccttctgcatgatgtataagaaatctcattgaatcctctctgccactgcatgggctggaactactacctgcacatacagttaggaagctgaggctctgtggggttatctcttgcttaagaatgaccgactggactgacaaagttcagccatagaattagagcccaagatatcctgctctataatgagtattcttccttaccacccttatatctctaaatcaacaaactgggttatttgtttctcttggccctgacttgctatttacctatctggatttccttctctttccctctgcacctggtcaaaagctgctcatccttcaaagtccagtttaaatttaattgtctctatataaatgttcctgagcaccttagcctgaagagacatgaatcagtcccactgaacaagactaactgacatgcatataatttaatttgcacaattgaacacctgctgtgttgtttcttcaattatgggcttggtctctttgcatcttttgttctgagttatttttttcacactgttgtaagctccttgggcagagtccataatttatacatctttgtatacctagtgggtctcagaacagttccttgcacacacaaaaaatgaggcaaaatgaagtcagatgtcttggttctcaatacagtcatctgttctggagttgttaagtgtaggatatcgaatgcttttcttaaacttcctggtctctgtctcctcttctttgacagtaggggtttgaaccagcgaatgtcagtttccttcagctctgttggactggggcactgctcctttagcttagggacacatgccgggaagagggaatgtgggactcctctggcccaatttccaggcacctggggccccagcaagcttaccttgtcagattcatcagatggttggactgtaggcatgaccttggtgttccttgcaggaaacaaaggccaggtgtgatgctggcagtgtgtctgtgtgtctcaggagtctctctgatgttccgtctgaactacatgtcgggagatgccagatctcaatccgacagatcaagccacatgtgcccagaaaggcttttggcgacatcacattcacttaggagctgtggtccatagggggctggggtatgatattctgaatggtgacggaaataagtgttcttattcttgtttacagtgcctttttgggaaaatgggtgaaataaggttctgtgtgagtgtgcatgtgcgtgtgtgtgtgttgaagtagggctggaatggaaacatggggggaaggatatttgaagctctgtagtaccgttccttattgaagtaacacccctcgcctaagtataaacttgtggatggcttccccagtgcaagtttataagtttgtaaaccccaggctctgcagattagatgtatgggcaactgaatttttttacacaagcagagaaattttaagaaatttaaagcataatcatgtacacccaaatgctggtggtttgtgctggcttaagaagcaagaatattcctttggttggtgtagcatttctctttactgaacagcattaaaatagcaacaaccgactatacacttcagagagaaccatctagacatggagagaaaagaatcaatcttgtttgtaggtagcaatgtctggtagtatccataaaatataacagccaaggaaatttcaagggagtggagcaatggagattttgtgcttaaagagggatcaattaattggcaatcatgtacaactctaggtataattatatagaaaacaggcaacatgagatcatttatttatttttatgagggaataattttattttatgctcattttactgaggctaatttcttcttattctaagaagtaaatgtgaacatgcctattgtgcatttgcaaaggaaattcaaacattgtctttgtttcagaagcaaatgctgtaaatgttgctatttcagaatgacttttatcatagttatagatgttctcatttatttgcaaatacatttaaagtgacaaaaaaggaatacttggggatttaaatagcatgttttcaactttaactgcatactgtatttagaatttaaaggggatctctgatctttgttttctcatacgttccacttgaggccacattattctagggcagtggtcctaatccacagattttagtctcttttccccacccctccagggcacatctggcagtgtctgggggcattttgattatcacaatagggagggtcccctagtacaggattctagtaggtaaaggccagagctgctgctagacagcctaaaacacacaggacggttcccatctacaaagaataatccagtccaaaatgtcaggagtactgaaatggagaaaccctgctcaaaaaaaaaaaaagaaagaaattttatttccttcttacaataatccatagttaatctctgagccccattttgtccacaacagcatggtgtcgtgacctaaaggtatatctcaaaagaatctctcattcttatcagtgcagaatagagaaattgtgtgcagcctacgtgtgatttgtcactttagtactctgtggtaggttatttgacatttcatgcttcatagtctgaaatgccctctcttagtatacccatctgacattttcgagagactaatgtttgcctaagaatgcttaaacgatggccagattttactctgagtgatactaccccctggaagtggggggaaaaaaagaaggagggaaaaaagttaagttttcattctaaacatcttcaaagcttgattggctttaataaggtatcattaattaattcaacagctaagaagggactgcaagtgttaaaaatcacggctgtcaaatgttatggcatctgggagccctagtggttggttacttaacatgatattttaggacaattctactctgcttaagcataataaaccggaaagacatgaacaaatgtcccaactgcttccctttctactcccaccccctgctctggaaagaagccctaacacctctaataccacaccactctaaaataaacccaaatgttgcacttattttactgctatgcattgagcattattatttggagatgctctatgctgcttcattaaagatctttcatatggggtggggaaactgagccacaggggatgattaaaagaaggaagaagtcagatgacttcggattctgttggctcctgactagagaacaccttaggaaaagcaatccttcatctgcagcacacagaagaaaccacattccgaacttctcggtgatgagccccgtttcctaacagtgtgaggttaatgaacctccttatttttggcagggtgaggaagtggcaagcagaaaaacctatcaaagggagcccagttccaaggctttaattgcttaggtgactattaagaaaagagcccccttctttcacagcagaaggatacagttctctgttcccaaatctggcagctattcctcaattatagaaagaagaaggaaattaaaatgtgatggattaaataagagggtgaaccggtacttatttcctaactagaaattaccatttttgtgcttttaaattgataattatcagcaccatactttattcacttttgtcataaggtccttccttttaattaaaattgagatgcttcacatttcttgcgttcccttaagaaaatctttcaagtgtttaagtccctgatattggaaagctttaattacagcatagaaaaagaagagtggaaagagctggggcggggggatgtgtcccttcatttcccgtgaacatgatcacactgggaactcagggaggtccagtgcatttgtcaacttgccaaacattatgttcattaaaggccagaaagtatccctggggggtggatacacttgagctcatttccaatcattttacctgctctgcctcatttcagagcccagtcagatcattaccagacttcccacattgtcctaaaaaaatgcattaaaattaagtcacaacagacatccaggtttgcacctgtatctcacacctgtgaggatcgcttttatattgaaataagacaaggttctccagagaaacagaatatatatatatatatatatgtatgtattaccacacacgcatatatatatgtatgtatacatatatgtatatatacacgttttaaattttattaaaaattttaaatatatttattttaagaaattgtcttgtgtgattgtaggggccggcaagttcaaaatctgtaagtcaggtcagcaggctgaaaacttaggcagaagttaatgctactgtcttgaggcagaatttgttttttttgtttgtttgttttgttttttttttcaggaaacctcagtttttgctctgaaggccttcagctgactgaatgagggccatgcacatgatccagttatcaaggagaatctctttacttaaagtcagctgagtaaattgtctaaaaaatacctccacagcacctagatgagtttgatgacataactgtgtattgtatagcctagccaagttaatacataaaactcatcatcacaggcatcaagctcaaatgttagggtttgcagtggactaatgcatacttaagtacctagatgacacccagaagggacaaaagccctgagcttccccactcagcatgctgccacctccatacccatgttgactctctttctgttttcaggttgtaacccacgtattctggttctgacctgctctattttctctttatcctcctggagcaggagtgaagtagcaagtatgttgagtcataagacagatttcactattccttgaatgctgacagaactcagagtcttatgtctcatgattttccacttgatttccatttctatgctttgggtaatgaggtttaacttgcctctccattgggaatacagattcctggaaggtagagaatcttattttctgtgtatagagttcatagttaggtttcaggtgatattcagaaaatacattcagaattttagagatgtatggagttgtgaaactagcaaaatattaatcattcttttgacacagagcctcactttgtcacccaggctggagtgcagtagcatgatctccactcactgcaccctccgcctcccaggttcaagtgattctcctgcctcagcctcctgagtagctgggattatgggtgcctgccaccacgcttgaccaatttttgtatttgtagtagagatggggtttgccatgttggccaggctggtcttgaactcctgacctcaagtgatccactcaccttggcctccaaaagtgccgggattacaggcctgagccacaacactctgcctaatcattcattttaagtgattaaatcatccattcatctacttttagtacatcctacatcctttttccttccttccttccttccttccttcttttcatccatccgtccatccatcgattattaattcaataaatatttactgttttccttcttttgagaggtgtatgacctaaactaagaggtatggagtttaaatgacttgtggaaaattagaatgttttattctctcgtttcccacaagtcatttatatagttgctaaaatttagtaactgcaataaaaatacatgattccggacaacatattctcattttacttacttctaatattgatatcagattggttctcctgcctctgagtctcagttgagatcagaaagcggtgataacagctcattgggaattggccatttgcaaccaaagtttgtgatatagttgggacaactaactgaataactgggtcacaataggagacatcttaaattactaaagctacatgattttggaaagtctggtttcatttatttaactaaactaccagtaataccttatgtttccaactttggtttttgtcagttgagatctggcttaatatccctcatggaaaagatggacaatttaggcaaaaagtatttataaagataaagtttaggcagggcacagtggctcacgcctgtaatcccagcactttgggaggctgagtcaggcagttcacgaggtcaggagttcaagaccaatctggccaacatagtgaaaccccacctctactaaaaatacaaaaaattagctgggtgtggtggtgtgcacctgtaatcccagctactcgggaggctgaagcaggagaatcacgtgaacccaagaggcggagttacagtgagctgagatagcaccattgtactccagcccgggcaacagtgtgagactctgtctcaaaaaataaataaataaacaaacaaacaaagtttaaagaagaagtgtatatttatgtattatttaattaacacatgcaccaaccgtacaactgccttcagaaagtacctttctgacaaaattagaataaaggagacatagtgggtagggaggagaggggttaggtgggtaaatttaggctatgccaaataaaaatggggcccctaggagtggggtgcctaggactagcattggcagaaaccactggagcctcgagccagcatccttttgctgaggcctctgcatagttgatagagcagtcccaaagatgtaaatggagcaattagatatcattcaatttatagtgctcttggcaagaaaaagatctttcagaattcttcatctgccctaggcaaacctttagaggctctcctcttgcttattcacacttgtggcaattttccaagaagaaattccactaaaaagagtctattttttaatccaaattgagaaaatggggaagtagtctaggatgatggtaggagttgaaattctggtgtcagactgccagagtgcaaaaacctggcccaggcctccctcctatctactaagcaggaagggggaggatgtgaagaggtggtggttgggggttggtttaccttggctaagctgctcctctaagcttccacattcccacttgtaaaatagagtaataacagtccttacttggcaaagtggttagaaggactagatgagccacttctgaagaagtgctcagtgcatagtaagcaagagaaatgataactgttgttcacatgtgtacagtgaatgggactattacatgaccatcacatcaatgataattacatttccattatttttccttttaactcataatacctttgggtatttagctggaatgcagcatattttactaaatggatacagtagaatgctccatttaataatgatatctactttgttttcttgtcctcaaatcaaagggacccgagtgcagtggtccagctattcaggaggctgaggtaggaggatagtttgagcccaggaatttgaggttagcctgggcaatatagcaagaccctatctctaaaaaaaatcaaatggagaaaactattggtccatattctatgttatagacaagatacaaaagacaaactcagattaatgcaagttaaccaactctataaaaattcatagaattttattattatttaaactgccttttctaccactgctatatttgttgactctgcctaggcatgctttaaaaattccataaacagctcacgcctgtaatcccagcattttgggaggccgaggtgggcggatcacgaggtcaggagatcgagaccacggtgaaactgcgtctctactaaaaatacaaaaataagccaggcgtggtggcaggcacctgtagtttcagctactcaggaggctgaggcaggagaatggtgtgaatccaggaggcggagcttgcagtgagccgagatcgcgccactgcactccagcttgggcgacagagtgagactccgtctcaaaaaaaaaaaaaaaaattccataaacatgtaaaagtatattcattactagatatccatcaacattgggagagaatctaaagcaacttatcccccattcttttacccagctgtattttctgctaagccacctatctcaatctgagattatattacacatttaaaattttctggtttatcatcccttcctaaaatgcatacctgaggagggtggggactcatttggtcttgcttaccagtgagcctctggtggactgataacactccataaatacatgtagaatgaatgtcaagtaaataaattcagaaaatgggcatttatgtttctaagttgaatatgtattcacaatttcagttaatacccacttgcttttattatttatcttgtgagatatgacatttccaatgcaagccttgccctactgaaaccatcatttgctgaatgtgtaattttcatcaaactgtactttaatattaatcaaaatgaaaagaatcctcttctaaatatttgttgaccttgagcttatatcatgtttgcataatgagatttaagtagaacatactttaaggtgcaaagagatattttttcatattctgtgttacaaacaagacacaatagataaactcagattaatccaagaaacaaaaataaaaaaatgaaagatcaagaaaaagctgttttttttaaaagattaacaaaatgcacaagcccttggtgtgattatcccagaaaaaaaataggacataaagaaataatattaagaatgaaaaaagttatctaatacaggattagtaaagatttttaatatcacaagagaacataattttgataaatttaaatcttagtttagacaattttctagcaattataattttacaaaactaactcaagaagaaataaaaatgtgaataaactactaattgtcaaaatattatatacaaactcgttctaagcctagaaaaaaaactgggagaagtcctcaacttattctatatggttaatataacctagataccaaagtttaaatctctttttttgaattatatgaattttatgaaaaattctaaataaagcattcataaattgaatattttaaaaccccagatacatcatgactcagggatgaggcttgacttgacacagaagaatctactaatgcaattcactacattaatagagaaatgtagagacaccatatgatcacctcaaaaagtgccaaaaaggcaataaaattcaatagttatggcttgtaaaaaccggaagtaaactaaaaacagatggagactttttcatctgataaaggatatccaccaaaaacaaaaataaaaacaaacataaaacaagtaaacacctacaaatctactgtgaatttctccctctgtggctacagatgagtaagtgcagggtctttggcagctaatagatctggaggagcccttgtccttttataggacttagaactttaagtacaaaagttccaaataagtttgacggaacaaataggcaccagcttgggcaaaaaaaaaaaaaaaacaaagctgagccttcatcacaaccatcttggattactgagcaggaatcctatacaagataatttttttaaaaagataaaacaacaactcatataatgtttaaataaacacatattaaagatttagcccattcgttaatgagggaaccaagatcttacagtcaattcaaagaagaattcaaaacacataggcacacacatacgaaataagaaatgctgaaataaatttataaataaatgcaaaattagtcaatatttccagggcaattgtgaactacatctccactgggtacaatttgtttgagtttttatcggcaggaaccagttggatgacagtttttgtggaggtgtgaagtagctcaaagacaacaaaaggcagagcccatgcagaaggtaccaccccaccatccgcttgcccattttaacatctttcacaatttctgttaacagtttaaattatattttgatgttgatctcttttaaatacttgattagggaataattttctttattctctgatgttgctgacgcttggcttaataaagagtttttattttcttatttctctttaaaacgtgaaatcagtggagccatatgccagtgtcagttagatatgtctatggaaagtcagaccacactcctgttgggccccagctggcttacctcaattgctagcaaaatgcttgcaaggaaaatgtggagacagcctaagctacagaaaccatcttgctttttttctgataacataagttttcaaagcaatatttaaacaaaagacaacatgttttttccccaagtaaatatctacagccttcctcccagcctgtcttactcccaaatcatgtccttgttatttgcaggtatccaaatgtctgcatgtgggagcattccttgtggattagggtgttagtgtctaggagtctcctcttttatgaaatgcaaacattctttgagcacaattgcaacatcagctgtgatatttacctaaatgtttcccaaggataagtggcttacgtcagagccctgaggctacaggatgtagggtttgaccagcaagagatttgagggcaggtaggtatcccatgagaaaaaaagtatcagagacacaacagcattatcccaggacatgaggtcctggaggttagaggcagcccacaagaaagcagtgatcccaaaaagagacaggaaggtgctaacgacaaaactcatctttgtgtctactcccaggctgatccgtgattaccaaaatgatccagtccacaatttccaatgctgaagacagaggaaagatttggggctgagagtgatctatgttgtttgtttatatacaagacattaggtaccctgggccattgacctcatagagaacaggcagcatttgttgtctgccaactctggattctgcaggcatcaaaggattagactctcataatgaaatcagccctttaagctactcggaagacttacgatagggatcactacccagattaatttgctaccaaatagagaatgagaggccaagataaacaaaagagagcagccagctggtagggtttgaaaaaaaaaatgcaagccattcattttccttttgttcttgtatttccaattgaattatgatggctcatcttttctaacctgatatgagctgaattttttatgatttaaatttgctcattatatttctattgcagagtggttctctgaagaacgagcctgttgctggctgtcagggtgtcatgatggtattgcgcaaatcctcgaggcagctttccagggctgctgtcagcctgctcatgccctttagccactgggcagtaaatgaggatctctaggactgaatacataatttgagggggttctgtgcaaaatgaaaatgcaaggtaccttgtaaaaaataagactttcatcagagcaacagggagcttctgggtccaggcctcaggccacacacccatgaagttgaccctgggggtctcagtgatgggataagcaaatcctttcccacagcaattacataaactgtcttgccagggactgaaggcttacaacttgggagtcagatacactttgtagctcagaaagctgactttaataaaagtagtgtacctagaagacagctgtttatttgtagaggtggcttgatatgttttgaatttgtgtccctacccaaatatcatgtcaaattgtcatccctaatgttggaggaggggcctggtgagaggtgattggatcacagggagggacttccccttgcttttctctcaataatgagttctcacaagatctggttcttcagaagtgtgtggcacctcccctactctctctttctccttctccggccatgcaagacatatctgcttctccttcaccttccactatgattgtaagttccctgaggcctccccagccatgcttcttatacagcctgtggaactgtgaatcaactaaacctcttttctttataaattacctagtccctgttagttctttatagcaatgcgagaatggactaatacatggctttaccttagatttcttggaatctgtaagttgatccaaattgcttgatgaatgtattctctagggatccatgtgaatctctctttgagaagatttttctcttgtggcttcacttagagtctatctacctttacataggtgcatttatattgaggtgattgattatttgggtaacagctccatgtatactatgatagttataggggccccatttgtattagggtttgtaattctgtcagcatgaagcaatcatttcaacggacaatatttaatttttaatgtaggatttatctaaccaggttctgcagaggtgttcttggggtgctccagtgctcaagttaggaaaacgctgctttaggtctaagtcaggttcgaatcaaaggttttgaggtcttagtgattaataagttctgtgccccttctaatgacggtatgtaagtccaaatgccatatgcaaatcaaatctttgaaggaattgatagaaaatggcaatcttcattcagataagatttagcctagtggttaaaaaaaaattccaaataaccaaatattgaggaataataatgtagcaacaacaacagttttgagtactcacagcatgacagatacttttggtgtatttttccagtcctgtgagataggtccttgttgatcctccattttgcagatgagaaaaatgaagcaagaaggattcagtaactcacccacgtctccaggcagcaggaggcagaagtcaaatttaattccccagaatctgactctaaagcaagtgctttaccctctcaatttcatttctctacacacttgtgctggaaaatgcatgaaagtttgcatgatttcacactttcacatgagcatgaagatcagaatttatggggatatgattgttttaaattgtaggttttattattattcaggcatagtgagttcagcagatcaggagatgactgccattgaaaggatggtttattactcacagttcccaagagcaggaggcagccacaccatacagggccttttggggaagtgccaggattggtcaggaagcagaggggctgggaggaaaacatggacaagagcatttattacagtttctgtgagaaggaacaggtgaggcaggatagacagacttaggattgtctggtttaataattccaaagggctctgggctgcaggggctgtctctcattgcctggtacctggccatgggatgatttgggcaggtgaatggtgggggaggcttgtgagaatctgataaagaaggtctttggggcatgggctctgggttagttggtttgcatctggaagacacccttgtaggcaaataatttactatctttagaaattggctatccctgggaggggcagtctctccagggtcagcaaggccccagatgtcaaagcttcagaattagaagatatgcttaatgcattgacctggaagacctgggctgacaagagggacagggactgctgcctggtctaaagagtcacctcttaggaccagtgtcctcccctttgttaaaagaagacaaagagtccttgaagagtgatcataaaaagatgatgccaaagtgtcttggggagacagccacatttttcagagctgtagccacatgtctcaaagatgtagacttgtgggtaaatggtacttgaagcagaaagcaaatgtgacacttagtgattgtaagtaatcaagatgacacttcttggtaattaggcagagacgataagtaattttttaaaagtttcagatgcctattgcttttgattttctctcctctctttgttagtctcctaatgtcaataagtagaattcatgccaatgacacctaacatcagtcctttctccctggcccagcaaataaacaaaaacacagaggaggctgcctggagaactgagtgttgcctctcacctgcagcacacaggacaagctgggttcttcgggctccacattagaggtctctttcaaccagtacccagatcccagcccaccttctcttggctgagttctggagcagacttccaagtgctcttttatttctgtttggaatctgggagtcttggtggttgaagacataaggcaccaagatatctgggcttggaggggaggattctagagttctaagcaggggcactaagctctagcattgagaagtagaaatggaagagaggagagggacgagtattgtgaacaaaaagttggggtggctgggttttgtacacccagaggttctcaatgaatgagtctccatcagcccctgaggcttcctctctctcaaggggcaggagaatacctggaggaagtggggtaaagaggtcatggagattagcagtttttcaccctttgaaagtgttaggccatgtgatggagcctccagacccagaatctcatttagtccttatacaacctgaaaaagtcttccaaaaccttaggggcaaacacatcccatctctttcatttttccccccaatgaaaatgggtttatcctttaagggcactcttatttggaggtccagtactcccccctttgatgttctctcctcctcaaattgtccacaaacctagagggctgatgtggtccaaatggacccaggtttaatcaaactgtctccccaatgaaagctaagcttcagttggtgctcgctgccacatggcttgagctgagtgctggtcctttccacctgaaagatactgccgggcagctgctgacccaagctctttcccaagacattgtgtttttttaagagtggccaatgatactcacttggagctaaactcagctaataggatgccatgatctgagggcctctgcctttagagctcaaccactagaacaaaaggtctctccctaccccctccttctaagggtggactccttgctactagcagggagccagacagtcttcttagacgttcccctgaaagtaaagctgctacctgctcacccttaggcagctacacctgattccaagctctttcagtatcttgaaattgctcgattctctttctttttcgtttctcaatatattttatttttagagcagtttatgttcacagcaaaattgagaagaaagtacagaaagtttccacacacccccagtctccatacatgatggcatcaccctagtcagcagtccacaccagagtggtacatttgttacaaatgatgaatccgcactgacaacttataatcacccaaagcccatagtctaagttagggtcactctcagtgccatatattttatgtgatttgactatatgtaatgacaggtatccacagagatacctgtatgacagagtgccatgcagaacagtttcactgcactgaaaatcctctgggatcctcccattaatcactccctcccaccaacctcttttcattgtttccatagttgtgcccttttacagaatgccagaccattataacaacacagtatggagcctttttagattggcatctttctgagttttggaaattatgtaaaaacctgctctacatgtccctgagaaggttttgattggatataagttttcaactcgcttgtgaaaataccaagaagtatccttgatgaattgtatggtaggaatctgtttagttttgtaagtaacagccaaattgtcttctgaagtgctagtaatatttttcataatcaccagcaatgaatgagagttcctgctgccccacatcctcaccagcatttggtgttgtcagggttttatatcttgtctgttctaataaaagtgtagtgccatctcattgttgctttgacttgcagtttcctgatgacatatgatgttgagagttttttcatatgctcatttgccatatttatatcttttttgacagagtgtctgttcaggccttttgcccattctttaataggttgttcatttttttgttgttgttgagttgcaagtattctttgaatatcttgaataatatttctttccagatatgtactatgaaaatatttttcttccagtccatggcttgtcttctcattctcttgacaatgtctctcacagaattttgggtcttttttgtttgtttttaaatttcaatgaaggtcagcatattaccactgtattcatggtgaattagattttctcctgtcttcttctaggggttttatagttttgtgtttacatttaggtctgtgacccattatgagttaatttttgaaaggggtgtaagggctaggcctatagtcattttttttttcctgcatgtggatgtttagttgttacagcaccatttcttgaacagattatcttttctccattgtactgcctttgattctttgtaaaaaatcatcagttaactatatttgtgtagatctatatctgaggtctgtattttgttcctttgatctatttgcctattgttttgccaatacaacactctcctgatgattatggcattgtaataagtatggaaggtgaataatatcagtcctttcactctattattctttaatattgtattgattattttgagtctttttatcctcatataaactttagaagcagtttatcaaaatccacaaaataatttcctggggtttagattgggattgtgttgagtctataggtcaacttggacaaaagtagcatcttgacaatattgagtctttatagaaataaaaataaaatatttctccatttatttagctgtttgatttctttcatcagaattttgttgttttcgtcttgtacttattttgttagatttataagtatctcatttcagaaagtgctaattttaatggaaaacaatttatttttaattaaaattcatttttaattataatttaatttataggaaaacagtttaattttgttaaccttatatcctgtaccttattataatcactagtttcagaaattatttttggttattttggattttctacatagacaacactgtcatttgtgaaaaagagcagcctatttcattcttcacaagcaatatatccgcttttctcatattactgcattaagactcccagtaaaatgttgagaaggggtgctgatagagaacatccttgccttggtctcgacgttagcagggtaatttctagtttctcaccatgttggttatgatggtagctctacattttttaataatattcattatcaagttaaggaaattctcctgtattattgagctggtttttaccatgaaagggtattcgattttctcaagtgctttcctttctattgatagggtcatgctatttttcttcttcatatataggatggattgcattactttctttttatttgttcatttatttattttcttttcaacttattttaggttgaaagggcacatgtaacaggtttgttacatgggtaaattgtgtgtcatgggggctttgtgtacagataattttgtcacccaggtgatcggcctaatacctgatagatagtttttcaatcctcaccatcctcccactctcaacggtggactggataaagaaaatgtggtacatatacaccatggaatactatacagttgttacaaaatgagatcatgtcctttgcagcaacgtagatcgagttggaggtcataatgctaagtgaattaatgcaggaatagaaactaaataaatacttcatgctctcacttataagtgggagctaaacagtaagtacacagggacacaaagaagggaacgatagacactggggtctactctcttaagaaaaggcaagatgacattccagtgtccacctggctagaacagaaaaaggaaaaaaaaaaaaaaaagaacattgactcattcccagggcatcttcctacacttagattctgaaagatagtattctttccatcactcctttcctttctactcttagcacaaatatccttaaacagaattttagagccgaagtcaaagtcactttgttccacatacataccccaacatctgctacttgttctcttgatacttaaattcacttaacaggagatctggccttttttccccaagctttaattaatggttaaatcttctgaaaggctagcagaagtaatctgttagtgcaattgggtttcactcctaattcttagtgtcattctacagttctttctcaagccgtgacctgtgatcaccatgatcagggattggcaaactacagctcatgggtcaaactcagtgagctgcttgttttgtacgagctgtgagtgtccacaaaagttttattgaaacatagccatgcttcttcgttgtccctattttcaaagaccagttttgttctatgacagcagagttgagtagttgcgacagagactgtatttcctgcaaaatctaaaatatttactctctgactctttaccaaaaaaacccccaaaaaacaaaaaaaaaattgctaactcctggtctaggtagtgtgaggttcagtttctggctccagcactcactattggggaggcattaagccagtgccattctcctaggaagtgctccacatagcagctattggcacacaagtcatgtggagatggggaatcctaaggaaaagaacgatcgactttggataaacttattgaacttttaaattctgacagtatcctgcttatataatttctgcacatatggaatctgcatcctgagtttttttctatccagttcatgtttgtacaagtatcttatatgtgcagatgatgaaacagtgcctttaagcaaatgcctttaagcaatgcctttaaacaatgccttgagcaaaatgatgtatttgagtgagtttattgtcagtattaccaagcacaatgtttgactcctgctttggtaatgtcaggaagtgtggcagatggtggggagacaagaggagtcattcaggaagaagccaggagctcccaggataaaagaagcaattaaaatgcaacccttggatgggctcaaatgcagtctgcctcctcttccttatcacgggccagatccagtctttcttaattgaaggggtcaagctaaagttcttatcaacaaaagtgatgttgcttaggaaagtcatattccttagctaattttaggtgctgttttgtgcttcctgtgttaccaaccttctaaacagtaaataagagaacattgctgtctataaaaaaatcttttagttgtagtgtcaacttacaaaagaattgacaaaaaggagtggaagttcttttaagtccttgccaggctgcagagcagagctagaagaacataaagtcttaatcctttccctgctctttaccttgggggtggtggatgtttttcagggctctgtgggggactggcgtggtgtttggtcatgctgactggggagccagatgatctatctgagctctggtgttggctttgccatgtattctgaaccgtcgaatcaacccctattccaggatggttgattttatgtgtcaacttggagacattttgggatgaaattaacgtttaaattgatacactaagtaaagtgcattgctcttcataatgtggatgggcttcatctaatcagttgaaggcctgagtacaacaaaaagaccagcttccccgagcaagaggaaattcttcagcaattgccttcaagagttcatctgcaccattggctctcctggtctccagcctgctggtccacactgggacttggacttgccagcctcaataatcatatgagccaattctttataataaatttatttaaatacacacacacacgcacacacacacacacacacacacatgcgcatttgatttctctggagaatcctgacaaatttaattctatgaatagagtaaaagtctctgttaacttataataaagttcctgttcattttaaaataaaaaaaggtactattggctcctggttgagtccttgaccatcatatgcacacatgctttaaccccagacagacagcttcattcttctttcttgcacaggcaaaacggcttctcatctttggagtagtcgagagtctaggtgctggatccagactccctaggttcaaatccgagctctatcacttggtagctttgtgaccttgggtaaaccacttacttactctaggcctcaattccctcatctgtaaaatggcaaaataagaatactcaccacataggattattgtgaaaagtaatgacttaatgcaagtaaagcgcttaacaaattatctggcactcagtaaatgcttgtcccacttagaatagacctggtttgtctgcagtgatgaaacatcagtctgctgagaacttggctagaaatgcttaagtagttgagtggagccttaaaagaagcaagtaaaaaaaaaaaattctgctatgtgcctgaaggagggagaaatgaaatccttggcaaatagaatgaataatttccccagttactattattaatatgtattatgtggctagcttcaccttgttttcttgctcagggaaaataatttctttgaatattagattgatgcttctatcaaaaagcatcttctctgtcctgtttaacagagaaaacatggttcccctcctccagtagttaaagccctgagctgtgtcctccagtgcccaagcagatagcatttagtatcttgggctgttatcaaggagcttctttatagaaggaattacaccttcggtggttgggggtgggggaaatagttaaaatgcaaatgtatcagtatttactagcttttggagctcacgtctcgcgcatttcattctgaactttttgctcaatgcctctgaaatcacccttgctaatttaggcccctcggaaataattccaccaaggcagaaaattggcaaccaaagaagtttcactggcctttagatcattttctttcttaacttgtaattttccgttgctttctgttctccattaacttttcatttgtccattatattacatgtgtagtggcaaccttgattttgatacatgatgtatattcactgagcaagggggttgatccattatgtggaccccttctgggaatatgtggactgtgtctatcaatttaagaatgttatatatggaaacataatgagtattataaataagttttaaaaacctatgcacacagataatgaacttcagggacattttaaatgaattttccttgtttttagctgaatacccaataagagtctaggtatattataggtgagtgatctgtgcccttgataaccttgaaatttggaatttttgtactgaataagattcatgctaagcatttaagggcagtctgttggattcatggcaagtgttatctattggattcataagatggatcttggagaactttttataaatagataatcccatgtgctatacctgtgagattcctagagcatagagataatcgctctttcaccattgccatttataaatgtgaaaaaagtctgaaaactcagtgaggagccttaaagaatgtctaggcacccaactcttgatgcatacaagctacccagtgtaagaatgtgcatcttatgaatactgaatattcagcattggttgaaaggtgtgtgggataatcgtgtgatagtgggaggaggatggcctttattatttgtaaatatgatatttaatgcaacccaagttttaattttaagccatttctcattagtgcatcttcatatgaaatttgaatagtatgaaatcaattatgcagaggaaaagtacttgactattgataggaagaaggaatgctgtattaggagtcaggagacatagctcagtacttactcagtatgtgactttcaacaaacaattgttcccctctaagcctcagtctcctgagttgtaaaatgaaagaatgacactggatcctgtttctaggttcctttgcactttcaaaatctttaagaatcttttgttgttgttgacaaaaggatttaaagagtagggacaagtgaccatccataagtgatgaaaagaaaagttaacccaagagatacataaagtggggaagcagcagagttacagttggagaaaccagggagtgaagtcgaggtgtgccacattccctctagatgactcttgaagggttgggtttctcttctgtaaaacagagaccatagctcagaggtttgttataaggattaaatgagataatgcataaaacatgcttccaggaataaagaatcatggaagtgaataaggaagaaaggagatggaggaagaggaggaagagaaaatgacttagaaaatgtgtgattaactaagtaattaatccttctaaaactttcacattcagccaaagcacatttgtgcatacaactctcatttgtctaccttggaataatcaattttgtgagttattcacagaagatgagtgaactcagccaggttttctaatactctgctaccttcttgttcacctattttctgactaggaggcatgtaactcaagttttcatcagcctaagcccaaccacattttggagacatgtctgcatcacaaattatcttgggctttcaaaaatcaaaaataaaccactttaccaaaaatcaatcccactccatcactttggtttctctgtgccttgtgcgccattattggcatgaggagttgtgagctaaccgtgccacattttcaggagcctttgtgccatcctgtttcagcccttgacaggtgctcctgcggggttctcaagctttccttttgatttccccaggatattatcattgtggctggtcaagggaggggacatcctgagaaaatcagccaacagttcctcctggaaaatccaagctctctgattagaggggcaagaaatccaactgatatgtatttaagcacttttatagaattcccgctatgtgccaggtgcacatagttcctaggtaataggatgcagcagccaactagctgaccaagtcctcttgaagctaacattttagtggagaatgtagataacccctcaaaaaattaataaagaagaaataaaatttttgataatgggatgtattatgaagaaaaataaaagcaggggaaggggcagtgaaagtgatggggtggtctggaaaggtcgatctgaggaggtgatttttgagatctgaatgcagtgggagaacaagccatggggaggaatagagaaaaagcaatggaggcacagaaaatattaaatacacagtgggtggaaacaaacaattaacttggccagtgcagctggaacagggtaatggttgaaggacggagcccattcaggtaggcaaaggttggagtttcaagaccttgtcagctaaagtaaggggtttggatcttatcagaattgagatggtaatctattgaatggttttgagttggagaatgatgcaacttatttgcatattaaaaagattactctgactaacatattgataacagactgtcatgagaccagagtggaagctggttagtagatgactgaaactgtttaggagagagaagaccgtgcatttcactagagtagttatagcaggggtagtgtagaataatgggattcagtacatattttggagaaaaatccagcctgacttttcgctgtgtttatgtgggacgtaaagggaaagaaggagtcaaggataactgctaggtttctgtttttagcgactgggtaaatggtggtggtgttaactgaggagatgaggtgctgtatcagtgaggactcatgcaggaaaaaaggaaccactccaggtgtattaagtatgaagtggtttaataaagggaatcgagtgctttcaaaagcattggattagctgaggaaacacaagttagagaaggtgcccggtagtatttagttctgctgtcactgcttgggccagtgaattcagaagttgttgctaccactcagatgaggaaagtaaaggaaaactagtgctgccctacagcactgagaagagtaactggaatggatcacccagaagccaccgcaaaaactcttgtctgccaaagctttcgtgtcctacattgatgcatggggaagaagagtatgttctgtgctctttcatctttgaaatctctcactagtgcacctcattagcagaatatagctgcaaccagaaactgaaaggcagaagaatctgacagataaagtttccagcctttcagctggcattgcaaaagaaagcatataacacaggacagaggagagcaatagaatcttgtaggctaagggacagataataaaatatttgtattgttatgtcataaatctgtgtgtctatcggacatccaagcagaagtgtcaagtaggaagtagaatacacaagtccaggaatcatgggaaaggtcaaggatggaaatataaattggggagccattagaacataaatggtaattaaaggcatgcaagtggagagtattacctaaggagtaagtgtagatagagaaaggtcttagaactgagctccatatgcttcgggaaaaacttggacattggggaaattaggaagcacttctagggttaaaaggactgaaggccgtgcacggtggctcacacctgtaatcccagcactttgggagcctgaggcgggtggattactggagatcaggagttcaagatcagcctgaccaaaatggtgaaaccccgtctctactaaaaatacaaaattaggcagtcatggtggcatacacctataatccctgttacttgggaggctgaggcaggagaatgacttgaacccgggaggcggaggttgcagtgagccgagatcgtgccattgcactccagcctgggcaaaaagaacaaaactccatctgaaaaaaaaaaaaaaaaagacaagttgggactgggacctgaaagaagctcagacaaatggcttacatattgcagtcaagactacaagagggcttagaggtcaggaagaagaggagatgccagtcaatgcgactgacaaggtgggagagcagtctacagagtatggtcctctgaaagtcaaatgtcaaatactgatgagagttatgttttgttttgcttttgtttttgcttttgtttttgttttgagacagtctctttctgtcacctaggctggagtgcagtggttcaatcacggatcactgcagcctccacctcccagttcaagaaattctcatgtctcagcctcctgagcagctaggattacaggtatgttccaccgtgcctggcctgatgagagtttttgttttttaaattaaattaaattaaattttacgttctgggatacatgtgcaggaagtgcgggtttgttacataggtaaacgtgtgccatggtggtttgctacacctatcaacccatcacctagggattaagcccagcatgcattagctatttatcctgatgctctccctcgtttcagcccctcgctgacagaccccagtgtgtgttgttcccctccctgcatccatgtattctcattgtttagctgccacttgtaagtgagaacatatggtgtttggtttcctgttcctgtattagtttgctgaggatgatggcgtccagctccatccatgtccctgcaagggacatgatctcgttcctttatatggcttcataatattccatggtgtatatgtaccacactttctttatccagtctatcactgatgggcatttgggttgattccatgtctttgctattgtgaatagtgctgcagtgaacatacgcatgcatgtatctttataatagaataatttctattcctttgggtatatactcagtaatgggattgctgggtcaaatggtatctctggttctagttcttggaggaattgccacactgtcttccacaatggttgaactgatttacattcccaccaacagtgtaaaagcattcctgtttctccacagccttgccagcatctgttgtttcttgactttttaataatcgccattctgactggcgtgagatggtatctcattgtggttttgatttgcatgtctctaatgctcagtgatgagagttttaagaagatggagtatgagagttcaacactgtatttggccagatggaagccgtaggaaaccttaagcagagtagtcttcaaaatcttgaatgaagtggatggaggtggggatagagaatgtgcagtgagcaaataaagagagaatttacacaattctttggactcattgtgatgtaatataaagagagcagaaaaaaagagcagcagttggaaatgatgtagaatctggggagagaccttttaaagaaaggtgatatcaaggcttgtttgtggactgagaatgatgtgtgatcttggaagtcagcttgagaatggagcagtcaagacacaaattggttggcaggtcatgatcagcatgagaggaatctctatcctgcttccaggctatccttggcactgtgatttttaataaaataatgcactgactttgcattcaaagaaattactggacagtcaaaatatacacacatatgcaaaaattgaggagcaatttcccataagatgtaagcaagagtaatagttattttatgttatttctgtaagtgttagtggcagtaagtaaagaatgaattgtaaaattgtgacagggaaggtagaggagtgctttttgaaacctattttccattagatcttaaagaaagttgagaacataaatttgtggagaagtgagggtgaagattcttaagggaggcagaagcaagatttaataacaatgcagaacaaggaatcagcaaaacctgttgaaaacgtcagaaaacttaggggaagctggagcagagggttagagttgggagacctgagtgagggtcttggctttcactcagtgtgcagtcaggatccacctaatgtggaataaccatggggttctggaatgggctgagacagtgacatatttgcccatattagtggatccatgaatcattttctacaaagtcttcttgttttgtttttcagacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctca

SEQ ID NO: 1011 - DNA, 35062 bp, Homo sapiens; identical to SEQ ID NO: 1010

SEQ ID NO: 1012 - DNA, 35062 bp, Homo sapiens; identical to SEQ ID NO: 1010

SEQ ID NO: 1013 - DNA, 35062 bp, Homo sapiens; identical to SEQ ID NO: 1010

SEQ ID NO: 1014 - DNA, 35062 bp, Homo sapiens; identical to SEQ ID NO: 1010

SEQ ID NO: 1015 - DNA, 2490 bp, Homo sapiens
tggcaaccaggatagaagatcagttgtgctgggggaggggagccagccaggttgtagaaacagcatccctgactttgttctgctaactgtgcagagagaggtgatagtctccgcccaggccatgagggacctggaaatggctgatgacacggtggagctcggccacaccaggcccagctggccccacagcaaaccagagggtccaagtgggtccatgccctgtcccttcctgtccacaagggcctctcaggggacagtggtggggcccatccctgggtgaggctcagtttcctgatttcaagtttccttccgcacagggaagctgggtcctgcccaccaaggtcccagggatcctcctctgaggccccctctctcctttgggtttagtcaacggagagggagatggggagaggactgaaaggtctccccaaaggtacaagctgagagacctggatttgcaatgtaagaacccaggagaaataagtggaactgacggggtctaaaatgtcacggctattctgtaaagcaggtttgtccctgttccatccaagtgtcctgagtgagcgggactctgcttcgagggtgtcaggttgaccctggctctttcccttgtgtggccctgctatctttggtacatgcctcccaaggtggccctggggacagtctccaatccactgagtcatcttcagaagtctgcatgcatctgcagaggggcaggtccttctcagcctggattccactaaacctcttccccggcagagtcaggctcagagcctcctcgtgcagccctggactctgccgggagcaattagtctcagaatctcgatctgagagagaagcgagcgaactggcagctggggccagtctggggtcctaagggtgttggggttccagaccctcacaggacatagaggggcagtggaagtggccctcccaggagaagtcagatcccttgcagggccgcaggaccccaactctgcaagggcaactggttggtcttttaaaaggatcaaaatgtgttgaagaaacgacagtaatgcctagaacaccaacctggcactaaaatgagtgaaacagagttacaaccagggacccgaggaagatccaggatattttgctgagtgaaataggaagatgcaaaagcacacatgtagagaggaatccacaaaaatctcaaaggacacgtactcactccctcctttgaaagcagaatttgaagaagcaaagaggagctgctccctgagcttctcgcatctcccttctcctcccttctcccttctcctctcccttcctctcccctctactcccctctcctggcttctcctctccacttctctcctctttcctcctctctcctctcttcttcccttctctctcttctcatctcctcccttcccttctcgcctcccctcttctctcctctcccctcctcttttctcctctcctcccttcctccctcccctccccactcctaccttcctctcctcctccctccttccctttttgcctcctttcccctcgtctccccttctctcccctcctctcccctcctttcccctcctcctccttctctccccttctctcccttcctcccctcctctcctcttccctcctcccctcttcttccctccactcctcccctcctctccccatcccctctcccccctctcctcttccctcctctcccctcctctcccctcctcccctcttcttccctcctcccctcctcccctcctctctactctcccctctcccctcctcccctcctctcttcccctctcctctcccctcccctctgccctcccctcctctctcctcctccactcctctctcctcttctttcctcccctcctctccacctccttccctctgtcctgtactctgctctctcttcttccatgttgtcttttcttatatgtactttaaatatttttgattttgttaatacaagtactgtgtatgcaattcatacctttttagcagacagctcacatggacccaagttggggttaacatgcagattgtgcaggggttccctgcggatgcacccctgtgtgccctgatgtggacctgctccttcctgcttcctgggctccagacagaaacaccgtacccctgcaccagcctctgcctcagctcttcacagtcagcacaccctccgcttcctgtcagggtgttctctgctgagtctggttatgggatccctttctgtgcagagccatgctcccgtgtcactgtgtgtcaccttcaagctgtccccgtgtgtatgcctgtgtgagaatatgtgtgtgtgggtttgccatcgaaggaaaacctttattttggctgctaacatttggaaacatttagagaacaaacaatatcttttaaaaaacatcaaaggttcaaaaaaacaagacaagaaacaaactgttgtaaaatttcaactcctctaaatttgtcttaaattgaacttagaactaatctaataaaaatagtatgaagtttcaa

SEQ ID NO: 1016 - DNA, 45084 bp, Homo sapiens
aggtgtttggagagcccggactggatgcccactagaatcctgtgctggtttgtagatttccttaagaccttaagacatgctgacatcatggtctcctttctcagattccttctctctttttctctttctcccccactctctctctctgtctctcactttctctcctttcctccctccctccctccctccctccttccctatccctccctcctctgcccaatgtctcccaatctctttcctttctctcttcagttcctccaggtaattcttactcaaacttgtaccaacttgtttttgactgacagtgaacagtgagagagttttcttcattttgaggaaccctaaacacctatctttcccaaggcaacctgtctggactgagcatttctctgacttgacataacttcccatccagccaggagtctgcactcttcagtctttgcaggtaagaggtacacggcgcttatgttaactctggggcatgtggcacgctggaggtatttttgaaaaactttacttctaaaggtaatgaaagcgttgtgattcttttaaagcttatttaaatcatttaagacgcccgtgcttatctgggggaatttacaagtgctgtttgcatgtggaaaacgggattttacttaatgatgggacaaaaaaaagtgttttattcttgctcgtgaaacaatatccagatgtcgtcttgtttgcggtgggtgtacgggggtctagcttgcgggacaagaattactccgacttctctttgcaagggtctgtcagagcaagtttgttgattttcagcgattacatagttctttggctaattctgaagcagttactttcctttgtcaatggggaaatcagtttagattgccgtaaggcgaaacctcgccggaatattttaaaatctgttacctatccttttgagaaaagttatgtaagttttctgtggtaggtgtaaggaatgtaaacgatcctgagtttggaaatattatgaactttgttcatgacccatgattaatatgttttttaatctgtgtataatttcatgagagtttagactatcctcagctaataaatgttatactgggtgaaatttccacattgctcctgtaacgccaacgtttgtctcctctgtacttccgcatttagtcacttgaaggaaataagaatttattgttcaatagacatttcttgacctcataatttcttttaacccacaggttagaaaacttacaacgaatgtagtatttgactgtggaaaactaaagaccaaaaatgtgtaccattaattcaaatgtttagatttatctttttcccctttacctgtaagagggattttgaaaaaaaaaaaatccaagtgattcttaaaattcattttttgcaacctcaagatcacaagcacacactcacactcatgcacaatcaactgttatccccaatcctatcttcttttgtcctcttgtgaatgtttaaacaaatatgaaacaatcggtagtaatagccttaggtgacaaattctctcctatttaaaattgtcctaaaaatcaaaagaaaagtgtcccataaagctataatacatttttaaatatcatcattttgtgaaaactaaatacagtatcagagacacttccagccgattaattaggtaagtaagcacttacctcacacacagcttccccgggcgctgttctttcttcccataccttctagggttttactttttagcagtttttctccttctctgttaatataataagtgaccatccagggaatggcccagaggccacaaggcaagtcttcccaaaatactgaagattagaagagtttaaccaaattcctggtagcagcatgtcagaaacgctcatcaaataacggaacagacctttcttcactgaattaaataaatgtataaatagtctgggggttttacagaaattgccttagttgaactttgtgattctggttgcttaaggaaaacacatttttctaaaacgtcctctctccatgtttccactccttcctcccaccaacagttgtggtcattttacagaaagtcttatttccccaatttcctctcctcacacttctcaccagtgcagacagccagtgttttggggggaaagagagcgagaccccaggctgcacatgccagcaaacctgagaagccaacaaaagcaggtctctgggctctttcccataaggctcagcacaacctcactctgcttctgcatcgaggaaatctcgaaagggctgtgctttcttggggcgtgtgtgtgtgtgtgtgtgcgcgtgtgtgtggtgtgtgcaattatatacctgaataacaatgacatactcgttataagaaaactcaccaatatgtggctttaggcacggaatagagaggcaaagttattcggatttaatcagtacatgtcaaatctttggaatatcctttcctgtgcaatcccctctcatctgtttagagactcaaagcagcccacgaagttttttgcatactttgcctcagagtccaggattgcttatgaaatgtatttgtgtggtggatgcgtcagagtcttagagccaacataagagtccagagactgagctgtaagcatgataaagctgtcaatgactggcccgtgggaatgcttgttgaaggcatatacacctccctaatcattttcttcagtctttaatatgtaagtgatacagctaccgttatttttttccctgcagcaattcaagcattgcaccccggattaaatcatgtatctctaaatatgttgttttaattctttcaagtaaaaataattccacaccgaaaattgtcagaaagccattacatgagttaatattaacttttatgtctgcaaagatgagtttgttgcttattcatgggcaaatacaagaggcaagtcagacagaggttattgtctaccttctctctcttctgtcctttacctttatctcataaaagccacctcaggagtggggcttttggtgcagctgatggtgggataaggccggggaagtctggatctagaacaaagtgaaccaagggtgagccttattctatgcccctcaaggatgcagtgccctggaaggagacaggtctgactgaacacacctggctcaggtaacttcctggtgccagttttgcagacaggtgaaggagcagtgtgacccggtagtagctccagagacaagcaatctaagaagtgctaaatcttccctaaaagaacacaaggagcctgctcctacctttaaaaggagaactaagggcagagagggagagaaactaagttataatttataaataaaggtttataaacatttaggaaatgcaacttctttcttggatcctttatttataagttctgacttagtttctctccctctatgcccgtgattctccatttaagaagttttatttgctaaatattactctgttgaaatgaaagaaaaaaatgagggggtagatatttctgataaaaaggccaggcgagaaagttgaacttgacaggtgtagcctctggaacacgtctctggatgaattcagatgatagtagggggatctccactcatcgtaatgcagctggaatacacatagtgaattctgtcacatgcccagggagaatttcagtcagaaacatctgtgctgttttcacaagggaaaggtcagaactccatgagtagttcatgtgtctgcatttcttttgatgggcattgtgcctcaactagagaagagatcaataagccaatagccgccactatccaatttgaatccagaagttcacacaacctaattccagaatacagtttgtgcttctagatgaaaaattctaaagcacaagcacacaattccagatattttagccactatacaaagatgaatcagggtcacgtgatcatgctcacgtcagaagatgcaggagaaggacaaagttttgcattttggtacaaaacacgcatgtgccagccacccgattcgtttccagtagggagcagttgagtggaaggtcatgtctgcactaccttaggactgaggacctacagagggaacactggaaagaattagcaacagaataagccaggttctgtttgattctgtctctcccaccctgcagctccaattcagagcagtcttaatgtgcagggatccgcatagaaccagccaagcagggcctctcgtagtagcctgaccagaagtcacagaggctgtgtaggccactcattccctcattcagagttcagacatcctgagcctgcccatgtccctgagattacagataacacgaatcctcagagtcaccgctgggccatcaaagaaaaaagagggtgacgcagagagggaacactgcaggggaggaatgcaattcttagggtgctctgaggacccaggtgcctgggtttgggtttcattcacatcctgcttcagtcggagctgccctggtgttgggcggatggctatggaactcatgtgcattttctttagtgtctacactggaggctgatgaagattttatggacccttaagattgcacaatttgggggctttctttagagaaaacaaatgcaaaattaggactgtactattaagtacaaggatttggataggacctgggcaagtgaggaaccctgaagctgaagtttcattaacttcttgataaatccactctgtgtcatacatagtaaagccctgatacttgtctcttgaatgaatggttgaattaacttatgtaaattttagctgctggctgctctctcaataactctgaaaaatgataagcaaaaaatacctatcatgtttatccatatctagtgatcagtgatatatggaaaaccaatcttaatgctatctagaatgtttcttgtttcattggcaccttgccatgaaaggtaggtccttgtactgtagttgaacctttaggtcatatctcagctcaagggtaagatgctatcaaagctgcttttcctatggtagaatatgtgagtactgaaattaactgtgcgctttttccacctgaaaagcccccaacttaaaacctaaagaacgttatgctagttgtgccactagaccctagaatggtattgaatgcatgaataataagcatcttcctgagcagacttgagggcttgccccagtggaatatctgtgtctttggtgagaagccttcctcttttttccttagtttctattaacgctgtttccaattttcaatagcagttaattgtgtcatttcttggtagaaatgctggctaaacccatgcctaccaagccaaataatgttctcactcaatgatgtttacattttcaaatatttgcagattgatatcttgcttcatcttagacctctttgccaaaaaatacaaggtcagctccctgaatcttgctttcttatttcctgagttatccttcatgtctattccaacctttaaaggacaaatttgaaaagtttatcctctgctttgaaagtttatgaaatttgtcatcatttgtactcttcctaccaacgccattctcacatatctgctaggaggtaaagaaaatataatgaatcctggagcacctggctgctgtgactagcatgctctaaatactaagaaataagaaacctgccctgtcttttttatattgtcagaagtttgtggaaagaatttatatatggacagtgagctgtattacatacagacacaaacatacaagtgacaaaagcagtgtgggtgtgtatttagctaggacattaataacaaaactgactgtgtaggtatagagaggctatcccaatgtcaacaacatcagaatacaatggtactgtattttgaacgtcttgtttaatatatttcaaatctataattttgacttacagtcaaaattaaacattaagtgcacacaaaacaattaccctttaaacagtatttttaaaaagtgatgtcatagtgacattgacatctgacatctttttttttttttgagatggagtcttggtctgtcacccaggctggggtgcagtgatgtgatcttggttcactgcaacctccacctcccgggttcaaagattctcctgccttagtctcccaaatagctggaattacaggcacctgccaccacacctgcctaatttttgtattttcagtagagatggggtttcaccatgttggccaggctggtcttgaactcgtgacctcaggtgatcctcccacctcaacctcccaaagtgctgggattacaggcctgagctaccgtgcctggccgacattgatatcttaacgtcactccttaaaacgagttggatataatgtcaaacgacttgattcttgtcaacaggaatgctgtgataatctgattacggaagactcagggtcttggttcctaggccctagggacagaagaaggctagcttctcccagacaggccaaagctgctttgaggagggaaggggaggtgaagtctccactccattgccagcaggacacacctgcctaggaactgggggagaactctcagaggctgaccctatacttcctgtctctggagtcaggggacaggggtgattctgctggtcagaaggcaggagggagtgtcctgaaacacaattgaatttgacagcaaagcactgtctatcctgggaagttctgctggtgagcggagtcctgtgagggtcctggtaaccctatccctgcaagaaataagaaggtctgcactcaaataggttcagaaaacctttcctagtttaggcccctcttgaatcttcacagcaatcattaacattttaaaaaccccaagaagttctgcagcaaagacgttctttaactttgaatccaagttgtacatccattttggaccgcagaactgtccaccacctcctccctgaccacaactatgattccctcctctgactaacgtttcacacaaccccacgggggatgctttggccaactgtgatgggtgtggagtggcaaggcatcgtgcgatccaaagaacatgtgtgatgtccaggctccatttaggtgtaagttgtactactggggcctgactacctctgcatgtgactggccagccttcgggattgcgaagtggctgcttacagtcagccccaaagaatttttttttactttctttctgtttctttatgtccaccttattcctaaaagaatttaagtgaatttacaaagatacatacacacacacacacacaccatgaaataaaagaggaggaaaataagagtaaatgtcaaaaaggccatttgattaaatcatttacttacataaatttgaactatttttaaaaatcacagttgagtgcacacagatccacagtgccagaatcttacttttgagctcaacattaaatatagatcttaactacatctgaacttaacttagcttcctatttgaacctgggaatcaactgggcactcactgaatgtagttttacacgcactgtattttacaattcttttgaaagacaatgtccattttcctctgtggatcttttaaattttatttcaccttttacacccctttatgtataatttgtttatactgagattgtaaactttcttcattggcttagactcaggtctggcactagcctaagggactaatctctggtccatcaggcctgggctgggaaccctctgtgggattccctccccattcccggagatagctggttcgccctgcttggccccactttacaatggcctgcttacttgtcccttttccctacagggctgcaaactctttgacaatggagattttatgtagttatttctttgtgctttcagggcatggcccaaggtattcttcaagcaatatgtattgaatccacaggcactgacatgaaaggcataatttttgctataattacatctttactttcaccatgaacttacatctacctcatcctgcaaacgcacagcagagacctttttatctgaagtcttttgaaaatatgtgtatgtgaaaatggctaactggtgtgttctctcccttggtgaatattacaaagtgatagattggctgctagaattgcgtaagtggggttattaaggagggagacatcttattaaggagtgacaagaaacagggaaccatgtgcttaagatatagaagttgtgtaaacccaacagaggagaaatagaaaacatgcaggttattttggaaagaagaaaatgaagacacttgaaataaaacagaaaagtaaatacggagccagcagggttcagcatgggagtgtgggctggaagtctgattctgaggaagaaaacaaggggaaaaaataaaagaaagaatatactgcaatcccaggctagaaaggggtgatttgatccatggagcagcaaatgcagaaaacaacaaaattagcatcatttcagtctccttcaaacgctatgtctagatctggcttgtgttagcatacctgtggcaataaaggtatttggctctgaatgtgttttaaattttaaattgaagagaattttctaacatttacccattttaaagatgaaatattataggactaaaacttgtaagggccacttttctgtgattacaatcaagcgaatttcattgcagctgggagcagcctatgccagtatatggcatttcagagtctagggctgcataaggatatgtacatttaaacatgaattgtataattatggatattaacatgtctagtccaatatcctgggaatgttccctaaatgatactttctgcacagcactttgcttagttttcagtatctgaagaaatggtctgacttgctagccctgtggttggtagaaatgtatatttgatgggtttttaaatcaactctcactcagattttgaatagtcaggctttaaccctcagtgatcttcaccaagtatattcttgccaagggcttactctgcaggaggctgggtggtccgtcttatgtcgatttagaagatataagtgacatcaaggactcaaggagcctccaggctgctgctggacagaggtgtggataggaagacatggaggtagagaaacagtaaagaaaaacacccaaagcacaagaaaggctgcagtgtccagcagaatgtgatgacattgacatgagaggccctgacaaagttccagggaaagtcagagagggaaagaccagatccctttgggatgactgtaagaggcactgggacatttgagatgtgccttgcagaacaagacgacttccagggtcaggacggggagaagccttcagagcaggaggagttaccatgcaccagcaggagggtgcgggaggtcggcagtgtgcacaggggctgagcttactgcagggaaagaatgggagagtgagggccacagtcaggacaaagctggcagccaacagtgctgagcactcctgaaaggccaggcagggctctaagtatttctttttgtttgtttgtttgtttattatactttaagttctgggatacatgtgcagaatgtggaggtttgtcacataggtatacacgcgccatggtgatttgctgcacccatcaacccgtcatctacattaggtatttctcctaatgctctccctcctctagcttcccaccctgctgacagtacccagtgtgtgatgttcccctccctatgcccatgtattctcattgttcaattcccacttatgaatgagaatatgcggtgtttggttttctgttcttgtgttagtttgctgagaatgatggtttccagcttcatccatgtccctgcaaaggacatgaacttattttttttatggctgcatagtattccatggtgtatatgtgccacattttgtttatccagtctatcattgatgggcattagggttgattccagggcatttgtgttggttccaagtcgttgctattgtgaacagtgctgcaataagcatatgtgtgcatgtgtctttatagtagagtgatttataatcctttgggtatatacccagtaatgggattgctgggtcaaatggtatttctggttctagatccttccatggctctaagtatttcttaatcctcacacaggcaggctttcttgctaacctctttagagatgaggaaagcagggtgcagaggttaagtaacacgctgaggacacaggcttcagagaggggtgaagctggcctttgaagctaggttgtccatctctagaagccacacccttaagcctctgctgcaggaggtgggagttaaacataggcaatgagaagtcattgaatattttggttttctgggtcctgagctgcactttagaaataccagtctggcagtgatgatcaagtgactaattcaaagggtattttgagagactgagtgaaaggaatgaagacctggaccagcatggtggctgtgggaaggggcaggagagacaccggtgcaagggagattcagcaggtggaatctggggcttgcactgattggatacaggagtacagttgcttaaagagggagaggtgagagaatgaggacgccattgttaggaaacaaaaatcaggagatgtagctggatttagggagaataatatgccttcagttttggatgagtcagttctggactgctctcattccaggagatgttggaaacagagactggatccctgaggagatgctgttagtgagcattgattaacaccatgggactctgaataggcagtagggtaactcagaggatgccaagagagaatagaaagatataataaaggaggatgagcacaagaccttggggaatataattacaaaggatggggaagaagaaaaacccaccacgctgcaggagagtgaactctcagagaggcagatagatgagcaatgagtctgctgacccactggtaaccaacagtaggaactttctgaggaagacacagttaatggcgccacccttgactcatatatcagagaagaggagatggagggagttgaagggaagaaacagtggaataggaaggcttggtagcaccttgccaactcagttcagatgaaaagcctgagagaaactgagagattatcatttggctggcagagcagagttctcagggtcctggaagctggctgtcttcaagcctattaatggttaatgtttctcatgctcttttttgctaaatttgacaaacctattccccttcctcctcaaagtcaactgagttattcactcagttaaatctatcatgacttaaaaagtatatgcttagcttggagagggggttacatctgttcttgtagtcacataattactggagacatgaaggaagattccagcaactcaggcgccttctgaacaggttgaatacctggtttttatgagcaacccgcttcagttttctgagaagctctgagtaactacaactaaacaagtctattcttgaatatgtttataataaaaaaggaaagataatgcagttatttgctaattgctgcaatgattaaagcaagatgtttcaagtttatcctttcataagaccagcagccttttgaacacaaacaggatctgacaaagatagtaataatgaaagcgggagaacaaggaaacaatgccagttttcttcagaacaatcggttgccactgacttctaacctacctacagtttcaagtttctttggctgggactatattctggtttttcagtgctgtactgtgattaagccaaacttcagcaaaaaaggaagtgctgcattgtagcagtattgaaagttatgtaggtggattttttaaaaaaaatattacagcctaaattttcttagcaaaagtcaaatgagtaacaacacacagtttggaaacatttggagaggagaaaacaaatatctgacaagagtacttaaaatctgaaaaaaaaaaaaaaaaaaaaaaaaaaagaaagtgggaggagagtgagaaaaagcccctgacaggtaatggtggaaacctgacaaatggaaggtcattctaatgagagaggcggcctggtctcatggaaagagactttggcctttggaatctgaccttcctggatgtgaattccaggtgtgcagactcctggcagcaatactcttgggaaaggtgcactaatgttctgagcttcaatttcttagtacattatggggcatatgggaaagagacagaggtgggctacttctctctccactccaggatgccaccctcccactgttccccaccttccttcttccccaggaccaggctgagctcaaggcttgtccctaaggcagctggtgaaggaaaggttcgacttggtggtagaagccctggactggagtccccacctatgggctgagggatcctccacaagtgattcaacttcttagtttctcacctacaaaaggcagggaaattcctgccacaggacaacaaggaagttaaatgacatgattttttgtgaaagtgttgtggaaagcacttctgtcttctatcttatgaatcagtagggaatgagcattctcaaaatgaccagaatgattcctaatttcctttctaaggacctgattcccttttcatacgttctttttgttctaaaaacaaaacaaaacaaaacttactttgtaaagaaagcctgaattccagagccagagtctgtccgttaaaaactttcaagctttttttttaaacttataaaaggcgttataccctatagccactcaaacttgtataaacaagagttgcaatgtgaaaaaactcacttgctgggtttgcctctatgaacaactattgttgtcaatgcaaattgaatccgaaattacccttgtcattgtttttttctggggttgcttctttcatttctgttaaaaatacacagaaacattaaaaaagtaactatctcctctgttttataaggagaagaagggataaagaaaaagaaaatcaacttggcatgcaagtgagccttgctctggaatttgggtgggtctaggaaaaagcaccgacctcagtggaaaacatatatgggtgtgtgggaaatccctgtaaactataaattgactacacagtgcttaagctggtgtggagagaaaccacaatactctctgaaaccagagaggaggggacagagagcaagttttgcacgaggagagcacaaagtgtccctgggagacagagctgctggtaattcttagcaggcttaactggatctattgaaagtgaccactgtaaaacaccactgttgcaccctggggttctctgtgggatgcccctacttgtatcatgcaggaaccctatggcctgactctgcttcacccacacttcttcccaccgctccccagcaaggccccccgccctgttcaattgctcctgtatgcttccccacttcactgccattgcctttgcagctccaattcctggaaagcattctttcccttttctattagaatctcattatgtagcttcgaagcccttcaaggcctgtcaagactcagctttcccttcccgatggggccttacctcttctacactttctaaatgttatcttctccaggctgaacaaaacctagtgtgtctctttgctactaaggactaatcagatgctgtgtcctgattcattcggtgttggtgtatcccatatctccaatcagattacgagcccctggagggctgacagcacgttggacttggctgagctagaatcagctcccttttgcaccctgagctgagtgcatgcagctcagcatttgtaatcctagcctaatgcaatgtgaaatttattatctctctttttacaaatgaggaaactgaagatcagggagacagtgtgacttgtccaaagtcactagcccagttgcctttcagaaggcatctcactccatcttcaggatgaccccaggggctaggctttcacactttaactcctcctagaaggtcataacctgaagatctgagatttgaacccaagtctgtctggctcctaccctgtacctttcccactatagcatattgcctccctatcaccaaaatgcccaacacgaagttgaacatggcataatatcaaatgaacttgtgatcatcccgttttgtcaaaactaagagaacataaaaaaaaatcagcaaatttgaccagagcagtgtatttatggcaagaccaaggcaaaacttgattctgcattctttgcattatagtaacagactgaaaaggttcataagtgtattcatatttaagggagtgtgtaactgttctacctgggtcaatgtagaattccctatacgttgcatgcatcatcaggaatttcatatgcagcagataggcatacagcctggtttctccaacagccaaaggcatttctgagtggcaacaacactgatctggtgaagctgagtccatctggacattggggagccccaggccagcagggtttctgctaagtggacctttccaaatcctctcagggacaaaacctggttgggcatcttcaagaaaagatgctcttgtaaagttggtgtagctgcttaaataagccccgaatagagtctagtccgtctctctgtgcttttctttaaatttcccttcatagaaagctaaaacttaaagaggtttcagagaagctagtctgaccccatctcccagtatcattgagaaaactgaagctcggaggggctgggtcatttgccggaggttttgcaggacacagaagagcttgttctcctaatgtggcctagaactcttcaccaggcctcctcctatcccaggtggaaactaaagaggaaaagatgaagccaaactcaggcggaagcaacataattaaactggtttatcgtttggcaacagagatcagaggagtgagtggaaagtgaaaatcagtgaaacacttgcagtttaaaagaggcatgcgattcctgcttttcctaagcagttgaaatgtgtttatatgtctttcctggagctctctcattgctaatgtggtcctataaggggaagtcctggagactgagctgggtgtatttgagtattcttctcaatggaaggcaatgagcttgtgtgctacactgcttaggccacacgatcccccaagcctgggctgccagacgtcgccatcattgttccatgcagatcatgcccatcctgtgcagaaggtcactataggaacacatggcacagggaagaaaacgcccatagaaattcacatggtgcttgtctaaaccgaaggcaggtgagatccacccactgtcatgggaagctgctagcatgctcccatttgtttataataatttctccaccgttagaggctgctttaaaaagaaacggccaaaacctgcgatccggtgccacaattgagacagaaagcatgggaccatgacagttttaagaattactaaagtatgaggcttgaccagatcatttttccaaggatccagagccctttagagagaattcaagagggagaatttctggtgacttctaccacctctgaagaattaaaaaacttacttgtgctgctttccaggcctctgtggtagttaattctgcttggcagtttttgttgtcaaatagcttttaagaaatctggagctatctcagatataaataccttaatgatgccagaggactgtctttcacccataaaaactgaagccatgtgccagaagccctcgtggctcaagggctctgtccttggacacggatgagggcagctgggcggtgggaccgaggctctgcctgaatgctcagcttctgcaagctggggtggagagtgtgttcctgcctaccggctcagccagcacaggagcacgtagcctgcaggtgtgggttgtacacaggcttccccctgctgagtcagttccccagatctcttcatcacttccccagatctctgggatcttcagctgagattgggccccagcacctggactcaaggtaaggccccttaggatgcttgtagctgatcaatcagggtagtgcaaaggaagaggggaaaaagccacccagaccttaaaggagatttctggaagatccaatcaaagtgattcaccttaacctcaggcatgacttttccccattatctgctgtttttaatttcaagtagtataaatcttactgatctgaagaagacttctgcttctgaaactaccagcgcttaacaatgattgagccctactctatgagattgcaaataaaaatatattaaccttggcaggaaatcaactgattaatacttataccctacactctaaagactggaacctcaatttatctgcataaacagaggctttgggtataaaagtaaaatgtagttggttatgccaaagactgctttcaatagtaatgcaccaaacatgcttttgaaaatagcaataaactattcatttaggttagatatacaaataagtaactttcagagttagcactaagttttaagcctcaaagactttgatttcagtgacaagatgtgtaaatgcagcggttagaaaaagtacacatactgaggtttctttcaagattatatatagtattattcaaaagtcttattgtatatgaaaagtgacaagatttttgcaatatgaaacaacagtagctagctaatactctagttacctttacagattgtctagttggtcacattataccttaatttttcaggatccaaccaaggcctggttaactcttactggcaatgtttgaaagggatgaaagaggtcctatgcatattactctaaattaatcttagtgcaggaagacaagtcatatttgaataactttattttgtatccctagctactgtcatcctagtatttgaaaagctccttttctcccaatgttcagaaagtcattttccaaacttgcaaatattaaaacctattcatgtctaatacttttctacttggtctatttccatgtcctgtcaatgacctatcaattaccctattcaattacccatgtcacttgagatttctcccaccagaatttaggttgcatattttcacagggcaatttattttaaaatcagaatggtccataaaactaatagctttgtgtgcacagacctaaaagatttgtagtagctctgcagctgcatttttgaacatcaatagttaaacgatcaacataaatgttaaagaagtaaattaactttcagaatttcacgtgtgctctagcattcaccattgaccatgctggaagaagactttgaggtcatttcatccaaccctctcattttacagatgaggaaaacaggactaattgatagctagcaatactaaattatagctcttctaaaactagacagcagcgtcagtaggcttcttcatgtgctcaattactgtatggattccacgagttgatgagcgtgctgtgaccttgagcatttacattctgtggttttcaaatgtttatgtttctaatgtggtatttgtaaacctgggccccagtaacctttaccactgaggctttgccaatcccaactctgggcagcccacctcttccatatgcagcagtgcttgcaggctgttccgcctgggcaaagtcatgttaggtgtaagcaaagacgtgaactagtgttcatgcttgaaaacctcacagagacctgcctgctggctgaatcctttcttcatctcttgttgcctctcctacatgtgactcaaaagctagccaagtttgttccacatccttcagcttgttcctcttacaccaaagtgccataccatcatcccctttagtaagatcacacttctccaatttctgtcctcctctactcctcaataaacaggaagatgctgtctgtggaaaatgcacgtggagctcttgcacacgttttctataacttgtcttccttccacttccccacaactagaatataagcctcatgagagcaaatgccttgtctggactgttatctcccctgtgtctagtatagtcaaaaatagtaggtgatgggtaaatacatgtgcaataaatatatcctttcatctttccttcctatcttagggaaacaaatgtccctttcttttctgtcttacctccctaataacatcagtacttctttgtccctcctccaatattgacctctgaatcacgtcctccttcttgaaatcttgccttcttaattgtctgcttttattaatttacataggtgtccagccatctggctggcctttctccagttcttttgctggaaaatcctctcctcttctctttaatacaggcagcctctaagattgccccttcagttgctttcttcccttggtatttttcttttttttgcagttctcattgactcatatctggtcaacttttacctctaggtacaatgattcttcaatttccacctccagccccaaatttaattcctagatatggacatgcttggagccaacaccaccatgtcacctcaatacactctgcttttcatccaaatcttcctttccatccaggcagcaaactccagagtcctttccactcctgttcaacctttctacttcacatatgacaggtgtgtgaattttacctggtggcaaaccaacgtggtgattctcttgaattcatgtattacttagacaaattcaacagcctcctaaatgatctccttctagctgctctcctccctctccatctgtcttgctagatgagcctggcttcttttttcctgcagaaagatcaaacttttcagtttaacccgcatcaccttttaaaattcattgccagtgtagttcccaatatggcctcatactaacttcagataccccagtgtatctgaagaaagtaatcccagctacttgggaggctgaggcatgagaattgcttgaaccggggaggcagaggttgcagtgagccaagatcactccactgcactccagcctgggcgacagaccgaaactccgtcaaaaaaaaaaaaaaaaaaaaaagcaaaaagcaaatgggaaacttttttttgaaaagatcagaggctccctttttaaaagagcagagctcaggctcttactcacatccctgtgccccaccaaaatattctgattttattgtcctgtgtcagagccaaggcattagttcattttaaaatccccctaggtgaatctcataggcagccatggttgaaagtcgctgataattgataaaccctatggcccaatcaattgggagtacttgaaacatactttgccaccccatagttttgcctgggcaattccccttgtctgtaatcttctttctcctatttttttttcctacagaaaacacatgataacttctttgatttttccagttagaaggaatcagtcctcctcctggaaatccttaataccttttaatatatcatattcattcatgtgatctaggcagaccttgtgttagatatggacaaaatggagagaaataagacaaggtccttgtctttaagcagcttacagtcttgccagctcactggttacacatgaactagtgagtatcaacttttatgatagaagtgtccatgggatactgttaaggcatgaaggagcctattctgcttggcatgataacaatttatgtatatgtcatctcttatatcaaatggtatactttcgagggctaagatcatgcatctctcacctttacgtatttcaaagaccacagtagtataaaatgtttgctgaataaatgagcaaatgaatgatgttttggtaattaggagtcactggggaataatggcagctcttaggaaatggtaccatagttccattcttggggtagggctgggcgtgtccccatggagttcacagaactatgtcataatttcagtactaaattatgtgtgttttacagtttctctcaatcacccattctatgttttatttaaaatggtaataggaatagcatgttagaaactgggtcctgtactcattaacaaaaagaagggagcaacagacattggggtctacttgagggtggagggtgagaggaaggagaagcagaaaagagaactattgggcactgggcttaatacctgggtgttgaaataacctttacaactaacccccatgacacaagtttatcaatgtgacaaaccttcataccctttttttggtaccccgaacctaaaataaaagtttaaaaaattatattttagaatatattcaaaaagtaggatattatttctcaaagaaaacatctgaattcatactttaaaaatattttttaaaacttgaagtttgatcaaggcatttacatcctaggagacaaaagcaatcatttcagtatgcattctagatttatcaactgcatacatattttaggaagattttaagatatttcaatataatatctaaaaatgaccacttaattttagtaaaaagagactcccaccttctggtaattgacaattactatggtctgagagtgtttagattaaaaaattgtgtgtgtgtgtgtgtgtgtaaaattatcacaggaaaatcaatacatcaatagtagcaccaaaaaagaaaaaaaaaaggaaagaaactaggtcctatttttcatgactaagaagttgacaatggtctttccaaattaagactcggcatctttgatttttgtaaacatatcctggagatcgaatgtgaacatttgatggctgatgggaagaattgaggaggattaggggagcacttgactttgccatgattctcaagttaaatccttggacctcttaaagatgttgttgatgaagctgctaaaatggtcaccagatgaatataaacaagtaggacccgcagtaatttccaggctaattttgtgcacgtgcgtttaggggcgagtcaaattaaatgaatgaggagctgatgttcatgtgaaagtaattactctcctccagtagaaatcctaatcctacaagtaactgcagaaataattaatcataactaagaagcaaaccactctcagggagaaaagctgtatctgaacttccacgtgctcttggaggatacgggtgattcacggcataagagtcatctaccaagtcatctgcaagagcgagtgcagcttccaagagggtctgagtcagaacagataaaaggaagttcttcttaactcagaagatttcaacactggggaagctcatttcccacagagatagaaaaatgtgcactataaatcactctcaaaaagcaatttagacaactacacaggtaatgataaatgcatggagagcactcacatgttttgggttgtgtttttgaccttcattcattctttatagattattaatccacggattaagtcattgactcatttatagtcatgagtcattaaaacttttctggagcatctaccacatgccagcaactgtgctacttagggtacaaaggtggacatggcccaacccctgccctcaaagaacttctagggaacactgactttgcaggcatgattccgtctgcatcacgcatcagtaaacagctatgtgtactgtagggtattgagacacaatgacgttccctctgctcagctcatcaccacaaccaatgtgtaggagcttgctttttgagacccagcggtgctttctataactggaagattccaagtttcctttgcttccatttatgcattcagcagacattaaggccctgctagaacctaggcattggcatgtacaagatgagatatggcagcttgcattccagtggaaggtggtggggtgtgatggatgaagagctggcttttgagtcagactacaatcttaaacattgtcgccactactagctagttgtgtgaccctaggcaaatgctttaacttatctagcctccatttacttatttttaccagcattactctgaagtgtggagttatacatacatgagctgccgacacagtactagttacatattcattctcaactagtggcagttgttggttggatcattattataattaaatatacacaagcaaaacagatatctctagtacactgagataaatattctgggagacagaagcataggcaatcatgtagagaaagccccaaacccatgggaacaggtggagaaagcacctacctagaaagggtaacaccccaaaggatagacatgagaacgctggccaagacaggaggtgggctttcgggcagatggcatggcatcaagtcaatcaatagaggactaatccatctgggcaactgcaagtcattctgcatgacctgaccaggtaacaacctaaggagtggctggcactaaggcaggtggggccagtttctgaagggtcagtttcaggagctgaggctttggtttgtagacaatggggccactaagctgggcggcagagtgctttagggacaccactgaggagggactatgaaggatgctatagagagaggacaacttgagatggggacctcaattatgagcctgtgctgtcatgcaagaaataaagtatgtggatctaaaccaaggcagtgtcacccaagaaagaaaatgtgtggatctaaaccaacgcagtgacagtgggaagggagaaaatggacagcttcaagggatgttggggtagactcggggtgctgagtatttttcagtgcctgagggtctacgggaggaagggagttgccctgggtaatggataatgaagctaggctgggtctaatttggggtgtttgtgggcaatcaaagggaggaaccacacacagttgactgttgttctggcagtcttgcaagagcaatctggaacacaaaaagtctaggcttcatgaactacaaaggtaacatctgaaaccatgggagtagatgcaggagtgtgtctttagtgaaaataaaatagttggagcatggagccttggagaaaatgccacttcaagattggcagaagaggaagaacctacagatggaactgagaaggcatcagaaaagtagaggtcaagttgagagaagagagtagcagcagactgaaatgctatggaaatatcaaggaagataaggaatgaaatgtatttgccagctgagttgtaagtaactctgaccaagtggagtggtgagctgagaggttactctcttggttgaagagtaatcacccagccctcaaggaagtggaagcaaagtatcgcttctgtcctttttaaagctcttctccatatcattgactctgctccccaaagcttggcttttagtgaaagccattctatttagacaaactcattgtctctcctctcaaccccaagacaagcattttgatctctttaactccatgggttttattaccaatgaatgaaataggacatggcacacagagcagacagaaggccattgccaaggtctttcaactggggtcccactctcaattttacttcctgaaagttcaatgtcttggctgaaaacagggctgaagatagatccaaggaagaccactgggaattggccaactaggtttaaactggggaacaactcccctcaagtggcaattttaagggtcttcatcctgcctcattggctttaatccctcttgaacatgtcaaagtggttggaagactgagtcctggtgggccacattgtgtttctgtggactgcggactagtttcagaggaagcacctgtctaacttaaccagggatcacttaggatgaacaccagttacacagtatagaagacataaatatttgaaattttatttgcagccactgttgcacagtgcaagctgtctcagaaattaaggcatatatatagttcaaatgggaccaaagtagtcttttggaagtcataatagggcacacatacatgaattgttgagcagaccttgtaaattaagagattcattgtattcaggcaatagtgtgtgggtgtgtgttcgctttctttgggaaaacagcatttgtaagccactcactcccaacatcaggggcacgtcagggtgagggtatatagaggtagctgttattagtgagaatataagcgacgcctgacttagcactctgttactgttagcactaccgaatctttgatgactaggtgtggtcaaaatcttggtttccagctatgtttcccataaatgaagtttccagatataagccaaatgcttaaacaaaattgctgactacaggatcattttgtaatactgtatgggtgatttataagctgtgtttttttaaagaatgaagtcatctagtggctttgaactttctccccataggtgaagttataagtccagcaagctcctcagtggctcctttctcaacagtcatgtgagagaagccagcctcaattaagccccacggcattcactgatggaataaattaccttctattgtatatgtctagagtgatgcttgctataaccatccatggaagaaatgagaacacagtcactcaaaccattttctgggttcagtaccgtgttgtccagatgaggaacagtggctgcaaaaggccgtttgctatgcagagtgtgagctttcacctccagcctcagcctcgcctgggagctggttagaaatgcaaattctcagacctactgcagaccttttgaataataatttgcatttaaatgagccctcagggaattcgtatgcaagtttaatcagtattggtgtgaagcaatggattcaaaaattatagcctctcgcagcacacacaaggatacttagggacatacatgcacaatatatacatttttcgtcttgctctaacaaattacatatattttatttatttttttcaacttttattataggtatggggtacatgtgcaggtttattaaacaagaatattgcatgatgccgaggtttggtgtataaatcctgtcgtgcaggtagtgagcacagtacctgacaggtagtttttaaaaccaccccacagccctctagtagtctgcagtgtctattgttcccatatttatctccatgtgtgctcagtgtttagctccttctattataagtgagaacatatggtatttggttttctgttcctgcattaatttgcttaggataatggtctccagctccatccatgttgctgcaaagaacatgatttaattcttttttatggctgcatagtattctgcggtatatttgtacaaaattttctttatccattctacatttatgggcacctggcttgatgccatgtatttgctctagtgaatagtgcagaggtgaacatacaaatgcatgtgtcttttggtagaatgatatagtttcctttgggaatacacccagtaatgggattgctgggtcaaatgacagctctgttttaagttcttttagaaatctccagactgctttccacagtggctggactaatttacatttccatcaatagtgtagaaactttccctttctttgcagccttggccagcaactattttttgactttttagtaatagccattctgactggtgtgagatgataactcttcgtggttttgatatgcatttctctagtgattagtgatgctgagcattttttcaagtttgttgactgtttgtatatcttcttttgagaagtgtcggttcatttcctttgcccattttttttaaatggagcaatatgttttttgcttgttgatttattcaagttcaccatggattcattttaaaatatgtataagatataaacacttaaaaggataaagtggaagctacaattgaatacttctatcattttgtcactgtccctgcttgggttactggtgtaccccacattggagacatctggtgtaaagaagcaaacagagccgaaaggaatcttagaactctttgtctatgatggtcagtgtactggggaacatgaaatacacagaggaagtaatttgttggatgaaattgaatatacttatgtttgcccatagtttttatcggttttgtcattttgagagatgtacaactaattttctcttcaagatagaacattgtggcatattctttgtgctacgaatcagaataggaagacgaaatctttatttctaattgaattgttcaaatcagtgaaatattcttcacccgaacaatgtgcctagctgtggactggattcctctctgggattcctctctgacctagaacgttgggcatcataaccttaggcaagtgacattcttactaaatcggacgctgagtccccttgaatggcatctctgcccaccgtgtgcctcccttaaacattaagttcctaccacatgccaggccttgtgtttgccactcaggatgaactactgtgcccagtctatggggaaagctaaactccaagactgatcattacagcagcacagtaagtattatcatgaggtgtggacaatgagaaggcagaagagaggaacaaggtgaacgctacctgcatgctggaggagatgacatttgagcggggcctcgagggatgcgtaggagtttaccaggcatagagcaaagaagaaatatggaataaaggggtcagcctaagcaaaggtatagggcaggatatctgctttatcagcagtatctctgggtgaagtgcaaactcttctaattcagtcaatgaaatgaagccttaagatgactgaaaactaggttcttggatttgtgcaatagatatttggaaatatctctgagagtaaatgatttcataatgtttggccacaacactgtgtggaaagtttctttgtgtaatataatacagaaagtacttctcatttacagtaaaatctggaatacttggaaatggtctgtgctagggaaactgaattttcagattaactgcataaaaatggaaaatctggttgaaaaaccttcctaattttgttttcctttagagagataactgctgttaatattttagaggtgttttattttgatcttacctagagagagaaacagagagattaccctgcatatttagctgtatcaattgccttttaaaaaacatatttagcattttttcatgatttttaaacactgcataatatttcagcctatgagtgttttataaatttaaaaccattcctatattgttggtgactcagattgcttctaatgttttaatatcataataaatatagagaacactcttgtacattatcctatcatacatttcctattaagtcttaaaagtagacttactgactcaagcagtctaacataaatagtttaaaactttgagtatacattgtcaaattactgcctccctcaaaaaagttatgctagattactctatcggacaccatgcaggaagctcttcatttctgcaaactcgtcaatgtagaatgttcacatgtcttttaaaattttcggtaatttgataagtgaaaagtgaattcctggtgcctttgtgtttcttggactgatggtccctcctcagtctcctttgcctgtatctctgactctgcctggtcttaaggctactcaggctcagtctgggttgctgcttccacactactgtctaagggggaagctcctgcactttcatggctcaaattccactcgttggcttatgtgctaaaggcatccctcctgtccaggtgtctctgttgaaggccaggcccatctgcacagaccctagtgcttacttctctttaggtgtctccaggcagcctccagtgcacaccttcaaacctgcaccccagaggtgagatcctccttctgcatcgggattctgcacaagcgtgagctccatgctggtataacacccaaacattcaatctgggtgtcccataacatgtgcataatgttaaaattacagaggaagatccagtgtcctctgaatcagtaagatagcctccgcccaccccaacacacctcatttccatgccaggaagcctggagtcatcggtgagacttcctcttctctctgccttgtcttcttaacatccacctgttggagacgcctgttgactctgtctgggacctgtcactcagagctcctggctagtagctctcaagctacaaacaccgcccttgtccatgcatcagtaatttcaactcagattactgaaagtgccgattaaacagactctcagcatctatgtttgactctttccaatacattccctatgctgcgtttaacatgatcactttcaaaagcaagtttgatcctttctcttccttgaataaaaccccaagatactccttgtgctccaaggatgggggtgacggtcctcaaggagcccacaaagccacatgcaggggcatggcatggctctgcccttgctcctacctgacactgcttccctctcgcctactcaatatcctcctcgtttcctggaaggtgccaagctccatgctccaactccagactaggacatgttatataccccatgtgctagtctctcatctatccttgactttctccccagttcttcccacaaatgtctttaaatcactcatctaatgatgtatttaatgcctcttttccctgttttcttgcaaactacccaagagcaaaaaccaagtcactcttaatgcttcatcagcagcatcctgtgccatgcttagcacatagttggtgctcaataaattcttgccacacaaaccaataaataaatgttaaagtgttgaaatgtcttttcaccttttcaacattttttgaattgcgtttctacacacgttgcccacttacgagaatgaaggctcttgttgatttgtgaaaactttatatgaaccctctgctgttcatccgtggtaaatgtgattccttttgataagtcgtattttatgttttatttgtcgtatgcatatgacaataacagttaacacttgtgtaatgattaatactaatcattatactaatcatacgagcaggcagagttttatggtgctttatatgtttttatttcacgtgaccctatgaggcatagaaatgatcatcatcgccattctgcatatgaggaaaccgagtctcaaaggggttaagaaagttgtccaaagtcacacagctggtgttaacagaagcagggtcctgtgctcttaatctttacgctatactgcctctgaagaattgtttaattttttttaagtacagaagagataatgttcaacctgacttttgaaggacaggtgggagttaaccaagaaagggagaaaatgaagaaccttcaggaaggaattcatgtgccagatgtgggctgagagggcacccagctgctcaggaaggggcaagtatatacccaggctctgttctgaggtgaataaagccagagagggagcgagagccagggcttaagggtctttttggttttccaagttgttcaggatttgtcttgtcagcagtgggagataccggaggatttatgaaagggagtattgtctcaattagtactctagatgagtaagctttgtctttcctggtaagaattatcttgaaaccatggcaatataaagttgcatgtgactgagtggtatattaactgtaaaaatccaccttcctggctgggcgcggtggttcatgcctgtaatcccagcactttgggaggccgaggcgggcggatcacgaggtcaggagattgagaccatcctggctaacacggtgaaacctcgtctctactaaaaatacaaaatattagctgggcgtggtggcgggtgcctgtagtcccagctacttgggaggctgaggcagaagaatggcatgaacctgggaggcggagcttgtagtgagctgagatcatgccactgcactccagcccaggtgacagagcgagactccgtctcaaacaaaaaaacaaaaacaaaaacaaacaaacaaacaaaaatccaccttcctacttccgagaagtgctacagtaaggctatgaagaccaagcattatgtatgtatctgagctgttttctgttatttccccctctgtttttatgtcagaagaaactgtaccattacttctagagtagaagatgttggaatgtctcctcattggtcttactgttccaatcacgtgagcaccaatgtaatgttcattactaacattagtgcctgcaagaatatcctactggaaagggaattagctgtgattttgttaagtgtccagccaattttcataaaagacacagtatctgagatggctgttaaacatgtcaagagattgtgtacgaggggaataaatcaaggaagactctataggttggtctgattctgtgatattaccagaattactggtaatatctacagcatttagaaacttcatccacagtcagatttaatcccagggctatgaagcctggagaatatatgggtagaactcaggagaatccacgatctcacatgaggagaaaagaacagcagtttattttagatggcctctaactaaaatttgtattgagtgtgtgcagcaaaccacagatgtactagctgcaactgtgactttgtcatagtggaaatcacagacatttcaatatcacattccagtcatttcagagaccttgaaataacattgctgctcaccacaccttcaaaacattagctctgatttaatgcttggaaaagtataattttgttttttcagtactgtaataggtgcattttaatatcattggtgtcttctgtaatctttgtgactttacttttatctgtttaaacactttattctgagaaggcaggcatgtgtctcactagtccaccaaaaaagaccataacataaaatgttaagagcccctgagctaatatcttaaaaatgagacaaacttcttagcttttctgacacctctggtaagccatgcatgaaaaggctgcacccccatcccgcagtggttagatttgttttcagagtttttagtactgggaaaatctggattgttttttttcttctaagaaggatggctttacgttaaaccctgtctttaagtttcttggccttaggaatgactcttgagcataagtttgcttttccctagggatgccagatttagcagatttagcaaatacaaatgtaaggccactctgtactatgcaaatctatagatacatatatgtaaatagtacatatgtatctctgaatttcaaataaacaatgaataattttagtataagcatatagcaaatatagcatgtgacaggcttatactaaattatttgctgtccatctgaaattcaaattcaactgggcatcttgtattttatctggcaactctaaaaacaccaaatttgggccaatagtcctccggctaattaactacagatggttagaatgtgttttcttacactgtacagtgatggaaattagttaactgccaaatgtcttaatttttgattgaatgtgaagatatttttaagtttgaaattttgtattatcattcagtgatcacagagtctgctttcaactttgggacaagcaaacaactgagaaatactaccagtctttaaagcaaattttggtataaactgtgttccactgcgatacagtttctatatcagagaaatgtggtcaaaatgtagactgatagtgagacagaatttcaaaactttttgacatttgtcccattgttaaataacttgtttttttctttgttttttttttttttttttttttttttttgagatggagtctcactctgttgcccaggctggagtgcagtggtgctatctcagctcactgcaagctccacttcccgggttcacgccattctcctgcctcagcctcccgagcagctgggactacaggcacctgccaccacgcccggctaattttctgtattttttagtagagacagggtttcaccgtgttagccaggatggtctcgatctcctgaccttgtgatccgcctgcctcggcgtcccaaagtgctgggattacaggcatgagccaccgcgcccagccataatttggttttaaatcaagcacaagtcgtaatttccattgcctgggatgagattcatgctaataactaatatgaatgccaatgaagataagaattttacctttgcatgcaggtgaattacatcagagcccattagtcatcaatttgtagagactgacaactccacatttatttcaaataaaagaaaatgtagtagtcagcatgaggccagaaaacaagccagcctgaaattgttacccatatttataaaacatactttctatgtttccgtgccttcatcgtagtgcaaaatattataaatgtgaggcaaagaaagataaatgtgagtggtaaaaattggcagactcaacatcttagtgagagagatagatttacttaagggaaagtcagtttggaagtattgtaaattatataatgatatggcataaaaaggcatgatccagtctcaagcatcttcttatgtctcacagaaacaggagttaagaaaaccagcatcactgcttacttcccacgtgtcatctcctgtgaatgctccaaccatgtccactttgaagtttcattaaataaaacacattaagccgggcgcggtggctcacgcctgtaatctcatcactttgggaggcggaggcaggcagatcacttgaggtcaggagttcgagagcctggccaacatggttaaaccccatctctattaaaaatacataaattagccgggtatggtggtgcatgcctataatcccagctcctcgggaggttgaggcacgagaatcatttgaacccaggaggctgaggttgcagtgagctgagatcgcaccattgcactctccagcctcggcaacagagcaagactgtctcaaaaaaaaaaaaaaaaaaaaaaggtcaaatacttgcttctctaccagtattatctgcaaaaacagaagccttccactctgatttataccacagtcagacaaacccaaacgctgtggatttccttctccttaaccaaatggtactgttttgagccatcttctcctctgttgtaggtttggactaatccagacaaaaatagtgagtgagattccactagcctgttgaagaaatctctttcctaaggagaaaattgggaccaggagcagtggctcacacctgtaatcccagcactttgggaggtcgaggcaggtggatcacttgaggtcaggagttcaagaccagcctggccaacatggtgaaaccccatctctactaaaaatacaaaaattagctgggtgtggtggtgcacacctgtaatcccagctacttaggaagctaaggaaggagaatcgcttgaatctgggaggcaggggttgcagggagctgagattgtgccactccactccagcctgggcgacagagacagactccatctcaaaaaagaaaaaaagaaaattgagcagtgcattacggaggctgacacagtacaattcgcctcctcaccccctccacactcacttccagacatcagtgttcctgttttgccagtcatctcacaacaatgcatgtccaagccacgctgtgattagagggagaatatgcttattacccaagttcttcgcatgttggagcagggagaggccaagggtggtaaaccacaggaaatttccatttgccctccgctgcggcactctcactctatagggaagttagttgttattaggtaataatgttcagcggaggttggtcactcgtaacaacagacagatgtgtaatgttttatttgggttagccagctctctcacaaataaagggcctgaaattaaactgtctttatgaaaatattcagtaaatgatacctctggcttattccagtgctcagattctttgccatggaaaatggcaaatgagtcccctgttgggcccggaatctgtttaaacttgtctttgtcgagtacagaagggttgatgttctatgagattaaaaaaaagtttttaaagaattcgcatcgaggagtaaagggaacaacgatgcaaaccacatttagagatggaaaagaattttttttagtacttatggaatttcaaacaataataatggaacagaaacataggaaaaaagctacatatctgaccacagaggcaaattgcattattacatgctcacatgcaatgcaaatgtggattggtctgtaaaggaacactttttgcttttctaatgtatagtagggtgagaggagcacctctccaatttgccaaggcatcactagcaaactccagctaccgaattgcttggggaaattgagttcttttgaagacaggttcttgggaactgtaccccaagaacttctggttaagtagctcaggtgtggagcctgagagcctgcatttctgacgatggagatgctgcggttggatgaggggagaagggtcacactattctataccaccctgtttccagtagccagtgagatggataactcatctcaacatagagtgtgaccacgaagagagatacctacccgtaaaatggactaagattcacaaaagcttgtttccagctctaaccttgttactggctcagtaaccttgaacaagttactcaaactttttgatccttttatctccctagatataaagtgtagagtttagaccagatcagcactcctcagtgttctcaaatgtcataaaaaggctaaacacacacacacacacacacacacacacacgtatatatagctacagttaagcaggttttataactgtaggacgtctcagaaactgtaataaacaaatgtgcaatgtggctctccaaagagtgaaaacaatggggtgtctgggggctcagcttcagctccagtaggcaaatccttccaaaagtatttaaccacaaattcctttatgtgtatggaacacctgaatcacacacttcagcaagagaacccctaatgtcctccagccttaactttcccatcctagaatctaggttctccccacagtcctccaatgttcccagccaggccaatgctaaaagcttcccttaatgatacccattatccaaggaagaaacctgagagcaattttctactacctgtttgcttttttccagcaattctcaactttttgccaagacattacacccgaatttctatccccaaggaaacattttctaactaaaaactccacctggccactgcagtacttatatatttaatcccaatgactttctccattcctttgtttgaaagtaatgagactaaattttagacaatctaatttcttggcttattcattttctccatattccagataacttttaagtggtgaagagtataaatcgtggttttccaagtgtagtctaaggtctaacagcatcggggatatctgggaaattatcagaactacagaccctctggctgcaccccaaacctgctgaatcggaaattctgaggtaggacccagtcatttgcatttttatcaacccctccaggtgattctaaagcacactgaagttagagacacagtgttgagatcagaagcatggactatggattccaacataccttgtgctatatcacagttcctttgtctgaaatatgggaataatattagtacttacttcagagtctatgtgagaattaaattaatatataatacctaatatcaggcctggcacagggtgagcaatgagtcaattaattacagctgcttaatctataatggatgctgacgcgtagtgagcaggaacttagctttgtcacactgcaccacgagactcctttgcaagctaatgctgatgatggtggttagataggagtgcagccgtgggagcagacagagctggtttgctcaccaggtgctccatgtattagctttgtgaatgcatgtaaattatttaatttctctaagcttagtttcgtcacctagaaaatagagaaaataatttctccccaaggtaaagagagggattcaataagataatatctataactgctttgaaaagtgcctggacccttttaagttgtcccttcccaaatgaaagctatcaatgacctaatgacagtggtacctgggcggcccagtgtgtctatgtgattacagatcctgaggccactaggtccttaaacttgggcttcttgctccacaaaatattagaatgataggatatgatacccttacaactttccctaaaaagctatcttgtcatgataaatgtaaatattgactcagaagtaatcaaaagataattagtcaccttttctatgttgttcttagggataaggcaagccattcttgccattacaatcttgttgaatttgggttctttttgtattcagtgttgagtcatagaccaacattcagagtttacattaagactatttcacaactcagttgggtgcagtggctctcaactgtaatcccggcactttgggaggctgaggtgagcagatcacctgaggtcaggagttccagaccaagctggccaacatggtgaaaccccatctctactaaaaatacaaaaattagccaggcgtaatggcgggtgcctgtaatcccagctgcttggaaggctgaggcaggagagtcgcttgaacccaggaggcagagattgcagtgagccaagattgtgccactgcactccagcctgcgtgacagagtgagatgctgtctcaaaaaaaaaaaaaaaaaggaatatttcagaactttatatctttcctttaaatgcagtaccttttaggtcaggcatataatcctaagataaaaaaatatgtattaatcgtgaaaatgtctctgtggtcaggtttcactaggttttgccttgttaacaactctaagaactgtgtggcttacagcaacaagaattttttctcacctgtgtttcaagtcagctgtagttgaattatggctcagttccaagtttccttcttcccacttaccagaaggaaggaacagcccaatccatgacccacccacatgcaaggcaagccatgtgatgatcccgacacctctcttcaggcatggtgtgggttactgctgttcacactccattggccaaagcaggtgacagggccacacctgacacaagggagtaggaaacacacaccccacccccgctacgcccgggcagggaaagtcccagtgaaggatcctttgtggaaggacccagccgagaggcacagcaaatagttgggagcaacatacatcaaccacaacctcccaaattgtcacagctctaccaatagtttccaagttcaaacacatcttccaaacacaggtcactgagaggaaactagcttccaagtgtgctgtaatctcaactggtgcttcccctgaaatcctgataattcccctggaggagaatgagtgattcttcagcctccaaggagctgtcattctttctgggccatccttcagtcctcagtagtctaaggaaaaagtgcttttgcagaaggaaagtagaatttcctcaggagatacaaaccgaaggattgccctctggaatctgctgagaatccactttgtccaccttgcttgttttcaatgaacatgtctgtttctgaggccacttggcaaagctatctgtgcccttggctggtatggatgagttaaaagctggactttgtacagtcagaccagcctttaaagcggatccttcactgctgcgtagtgtagggaggaaaatggcccaaggccaaggccaaaggtcatggtgcatgtgctcctgtgaccacagtcgagggagcccagggaggagagctaagcctttattctcaattgttttaagcctcctgagctcagtgaaccccaagtagattcttgtcaagcattttttttctacttaatatttaaaacggtgatacttaaagtcaaatttaatccaggcattttttatttctggacaaagagatcattgaaaaattaatttgtcagaaatatatgacacgcaaaaaagcaaaaagctttttaagtaacttttcttacaaacaggaagctatgttttttcagagcttaaaagtgagatccaccacaagttaattttagtctagaaatccaaagttactatttgatttagatttcactctttatgcctcatcaccctggttaaaagacgtggaatgagctcgctgaaggcctagttgaggaaccccggttctggggagccactgtctccccatttttctgtaagtgagaaatgttttttctaaggggcctttgctttgttagttcactgtgaaacgcagaatgaagttttctcgagatgggcaaattgaaaatcttcaaaatctggcctaacagagctctaagttttaaagacatcaatgtctttaaacattgccatcatcaacatggcaatgggtactacccttccatttcccattatccttgctgtgtccccaacactggaagtgtagttctccatatagctaagtacctttttcaatgtgccttctgttccattctgtttcagagtgtgtttattttctttcctttaacttcagaaaactaatgctcacagcataagcactcagtgacctcagaccattaatcttttactggtttgaagtaggagaaagtaatactgacctatccattcaatagttgtaagaacttcacttaggtagatatcgccattctaaaaattgcaaccccaacccacaaactgaaacgatataacaaaaactgcagaaataaacattatttccagaaattaaagaaaactgttaatggtttatatgaaatattgcttagctgggaggattaacccttttctcatttgccctgagaatactcactggcagcacttgaggctgcaatatttacctggagatgattttgccacacagtatattacttttattattattttcatatcactctagtatatcaactttggaaacaaaagacaacattctatttagagcattctgcttttagtagtggtatttttatttacaaaatatagtaattcttgatcgctgaaaatgtcaaatcctggaaaacacagcattcctacacatggtgttaacattggtctccaacagttgttggccagagattcatttgatgaatccaatttttccgaaatagacaattctgatgattcagatgattctgatgttagttctgtttagaaataactccaagaacaatttttatgttttactttcacattgaaaatcaatcagatttgcttcagcctcgaaaagcatgtttatgtaaaattaagtgagtactggtggcaagctgcacttttttttttaatgggaaaaaggttaagataggggaaattagaagaaactattcttctctcattctttgtgtttttatcttttggaaaactgttattgttgcttaccatgttagaagttaagccaggtctattgaagaatcactaagggaatataacctaaggcagtaacataaaattatatgaaataagagtatgtatcaacactgattcaaacttcatgaaagaagtctgctgaggaataaaattctataaattaagagcctatgatgaagtgcaattcataaagcctatgggtaagattgatgggcacaaagaagattctgggtcttaatagagcaatgacaaagaggtcatttgccaaacatgctgtggccacactggcaggatccagcctgtaagaggatgcacaggttaattgggaatactttaactataagagagtaataactgtaaataattggcagatcagaagaaacgtaggaagtataagtgtgcctgtgtgtgtgtgagagacataaaaatatatggatgtagacagatggatgattgatagatagatacagatcatagataattgataggtaatagatcaataattgacagatgatagataatatgcaggtagatatttagaccggtaataaatagatagataattgatagataatagattgattggtgatatataataaatgatagattagagagataattgatagataatagattgatagaagatagataatagataggcagatagcttaggaagaattattttcaaaaagtacatgcaaaagaacctcttgaatttaaaggagattacatgaaactgtggatgtttaaggggattttgtggtggactgacaggaaccctgggctagcttccaaagactttggaccttgttctttctgccaggacccagctgtgtcaagtgggatggttctgacaatcttttccactctaatgtcctatgactcaacagtagcaatgcatttccacaggcggtaaaaatattctagactcttcccttccagcgctcactgtttacttcctctgcacttccccttcctgcctccccgtgtgccggtcagttcatagcgggcctcaatgagggtgggttaaccctctctttccagggtgttttgctacggagctccctccaggggctgggaactgtgtggtgagggctgtggttggggttcagcttccttcttaaatcgttccttgaacctttaccctattctgtgcactgtgccgatttccagggattggaaggtaaatgccactgcgtaactcttagaaaatcatcgggggtcagttttactggggtgcacttggtaaccatctatgaatccatgtgtccctctttctttcaggcagtagcagaatcccatggtagccaggtgggtgaaggggagcgaggacgttctacctgccttgaagaagacacctgacctgcggagtgagtgaccaggtagtagacggttctgagggcatcacacacttgagggagggaggaggacagagagggccatggcaccctttgactgctgagtgccagctgctctctttcccactgagaaatgctgcccccaacacacccagaggctctaggtcttgtcctgtgatttctgtccaccaagacttgataggaggtatgatagatgccattaactccagcactatatacacaggactgcagcaaaagcgctctcagcagaaagaggaaacagatacagttcatcccaagcctggcttgctgcccctttgaaagagagtttcaaacagaagcttcatggtgctgccttcataaaaacagggccaagctttccagaatctggcagagggctgagtgcccgcaggacacttgtgtatcactcacactggaaaacttaatcctctgtttttatttcagtggattgaatggcatgcagtttcctcagcagcttaaaaaaaatgcatgcagtcacttgcagacaggctgcatttgtctctgctggtgctcatgttacaagtttgtctgtgcatttgggcatgccagaatggcgtttcatttccaaacctttattgtggtcactttcctcttcgttacactgagaagtgttgctgagggtatagtaaggccctagttcatcaattatatcctgtacttttcttctaacttgatcccaagaacagtggaatttgcttcaaggtaaacaaattttgaataatttatggcccttcttttcaacaaaaatgaaaacgtgactttctaaagaaaagtcaattacaagggggcatttagtaaataacacactcttaataaagtaacaggaaaattaaaatgcccagcagacccattgcctcctgaacaggtgtttgctgctaatggatacagtttccatttccttgaagggatttgcccagaggattactttcacaacttctattgagataatactgctctaacagaaagagcaatgcatgaatctgtatatcagttccttaataaaagggaagatttttttagttcctaaaataccaatgaggtgaagaaaaacatgccacccaggtaaagttactctgtaatcacccgcattatctttttcaaggaatgtgggggaaatttatgtcagtcatcaggcaggtactagaagatgctaggggcctcacagacagcttgttcccggctgttaacatggagcagagcgttccctggggctgagcatgggagcccagcacttcttataggtaggtctttcctactataatattagatgcctacacttattgactttttcatttgctctttaaaatagatttcttctgctggttctgcttagttctaaggagtaaggtagaattttggtgccatacctaaatatcacgtctaaaatgacattggtagcacttttccaagaataaccagcatattgatcaagccattaataaagcctaattatttgctttaagaatgtttttggttgtttcaaactgagttttttccaaagtcataacaaaactaggagaggctgtagattcttaattattcattagattagggggaaaacgaattgctattacaaagaatatcatgcaaaaaataggttttaaaaaatgcattactactgagttttaaaaatgtatactaacattctccatatcaagaactgtttcatggatggtagattttagttatagcagtactggacttacactcagtcaaataattttaaattttctataattgggaatacatggtagctgaatataagcaaacatattactctatgaaataaatgcataagagtttgttatcacaaaaaacagcataacattatttttttgaaacacaaggctctgttttaacactttaccttgtttaatagtaacaaaacccctgaggaataggttgtattgccattttaaacactggagagcaaaggtccagagaggttaaatagctttctgcaggtcacacagctgatgaattgcagagtcagcatttaaccccggtctgcttttctgcaaagcctctgctcctcactctaccctaccgaccacctaagtatagatcagttaatcttgccttcagaattctcctttcttgtgtacttccatgtacattcatacttacttcacatgatgattctattttctggaagttccaccacatatggcgataatgaaacatctttgtcatttctctaagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtccaa

SEQ ID NO: 1017 - DNA, 29319 bp, Homo sapiens
ccagatctctgggatcttcagctgagattgggccccagcacctggactcaaggtaaggccccttaggatgcttgtagctgatcaatcagggtagtgcaaaggaagaggggaaaaagccacccagaccttaaaggagatttctggaagatccaatcaaagtgattcaccttaacctcaggcatgacttttccccattatctgctgtttttaatttcaagtagtataaatcttactgatctgaagaagacttctgcttctgaaactaccagcgcttaacaatgattgagccctactctatgagattgcaaataaaaatatattaaccttggcaggaaatcaactgattaatacttataccctacactctaaagactggaacctcaatttatctgcataaacagaggctttgggtataaaagtaaaatgtagttggttatgccaaagactgctttcaatagtaatgcaccaaacatgcttttgaaaatagcaataaactattcatttaggttagatatacaaataagtaactttcagagttagcactaagttttaagcctcaaagactttgatttcagtgacaagatgtgtaaatgcagcggttagaaaaagtacacatactgaggtttctttcaagattatatatagtattattcaaaagtcttattgtatatgaaaagtgacaagatttttgcaatatgaaacaacagtagctagctaatactctagttacctttacagattgtctagttggtcacattataccttaatttttcaggatccaaccaaggcctggttaactcttactggcaatgtttgaaagggatgaaagaggtcctatgcatattactctaaattaatcttagtgcaggaagacaagtcatatttgaataactttattttgtatccctagctactgtcatcctagtatttgaaaagctccttttctcccaatgttcagaaagtcattttccaaacttgcaaatattaaaacctattcatgtctaatacttttctacttggtctatttccatgtcctgtcaatgacctatcaattaccctattcaattacccatgtcacttgagatttctcccaccagaatttaggttgcatattttcacagggcaatttattttaaaatcagaatggtccataaaactaatagctttgtgtgcacagacctaaaagatttgtagtagctctgcagctgcatttttgaacatcaatagttaaacgatcaacataaatgttaaagaagtaaattaactttcagaatttcacgtgtgctctagcattcaccattgaccatgctggaagaagactttgaggtcatttcatccaaccctctcattttacagatgaggaaaacaggactaattgatagctagcaatactaaattatagctcttctaaaactagacagcagcgtcagtaggcttcttcatgtgctcaattactgtatggattccacgagttgatgagcgtgctgtgaccttgagcatttacattctgtggttttcaaatgtttatgtttctaatgtggtatttgtaaacctgggccccagtaacctttaccactgaggctttgccaatcccaactctgggcagcccacctcttccatatgcagcagtgcttgcaggctgttccgcctgggcaaagtcatgttaggtgtaagcaaagacgtgaactagtgttcatgcttgaaaacctcacagagacctgcctgctggctgaatcctttcttcatctcttgttgcctctcctacatgtgactcaaaagctagccaagtttgttccacatccttcagcttgttcctcttacaccaaagtgccataccatcatcccctttagtaagatcacacttctccaatttctgtcctcctctactcctcaataaacaggaagatgctgtctgtggaaaatgcacgtggagctcttgcacacgttttctataacttgtcttccttccacttccccacaactagaatataagcctcatgagagcaaatgccttgtctggactgttatctcccctgtgtctagtatagtcaaaaatagtaggtgatgggtaaatacatgtgcaataaatatatcctttcatctttccttcctatcttagggaaacaaatgtccctttcttttctgtcttacctccctaataacatcagtacttctttgtccctcctccaatattgacctctgaatcacgtcctccttcttgaaatcttgccttcttaattgtctgcttttattaatttacataggtgtccagccatctggctggcctttctccagttcttttgctggaaaatcctctcctcttctctttaatacaggcagcctctaagattgccccttcagttgctttcttcccttggtatttttcttttttttgcagttctcattgactcatatctggtcaacttttacctctaggtacaatgattcttcaatttccacctccagccccaaatttaattcctagatatggacatgcttggagccaacaccaccatgtcacctcaatacactctgcttttcatccaaatcttcctttccatccaggcagcaaactccagagtcctttccactcctgttcaacctttctacttcacatatgacaggtgtgtgaattttacctggtggcaaaccaacgtggtgattctcttgaattcatgtattacttagacaaattcaacagcctcctaaatgatctccttctagctgctctcctccctctccatctgtcttgctagatgagcctggcttcttttttcctgcagaaagatcaaacttttcagtttaacccgcatcaccttttaaaattcattgccagtgtagttcccaatatggcctcatactaacttcagataccccagtgtatctgaagaaagtaatcccagctacttgggaggctgaggcatgagaattgcttgaaccggggaggcagaggttgcagtgagccaagatcactccactgcactccagcctgggcgacagaccgaaactccgtcaaaaaaaaaaaaaaaaaaaaaagcaaaaagcaaatgggaaacttttttttgaaaagatcagaggctccctttttaaaagagcagagctcaggctcttactcacatccctgtgccccaccaaaatattctgattttattgtcctgtgtcagagccaaggcattagttcattttaaaatccccctaggtgaatctcataggcagccatggttgaaagtcgctgataattgataaaccctatggcccaatcaattgggagtacttgaaacatactttgccaccccatagttttgcctgggcaattccccttgtctgtaatcttctttctcctatttttttttcctacagaaaacacatgataacttctttgatttttccagttagaaggaatcagtcctcctcctggaaatccttaataccttttaatatatcatattcattcatgtgatctaggcagaccttgtgttagatatggacaaaatggagagaaataagacaaggtccttgtctttaagcagcttacagtcttgccagctcactggttacacatgaactagtgagtatcaacttttatgatagaagtgtccatgggatactgttaaggcatgaaggagcctattctgcttggcatgataacaatttatgtatatgtcatctcttatatcaaatggtatactttcgagggctaagatcatgcatctctcacctttacgtatttcaaagaccacagtagtataaaatgtttgctgaataaatgagcaaatgaatgatgttttggtaattaggagtcactggggaataatggcagctcttaggaaatggtaccatagttccattcttggggtagggctgggcgtgtccccatggagttcacagaactatgtcataatttcagtactaaattatgtgtgttttacagtttctctcaatcacccattctatgttttatttaaaatggtaataggaatagcatgttagaaactgggtcctgtactcattaacaaaaagaagggagcaacagacattggggtctacttgagggtggagggtgagaggaaggagaagcagaaaagagaactattgggcactgggcttaatacctgggtgttgaaataacctttacaactaacccccatgacacaagtttatcaatgtgacaaaccttcataccctttttttggtaccccgaacctaaaataaaagtttaaaaaattatattttagaatatattcaaaaagtaggatattatttctcaaagaaaacatctgaattcatactttaaaaatattttttaaaacttgaagtttgatcaaggcatttacatcctaggagacaaaagcaatcatttcagtatgcattctagatttatcaactgcatacatattttaggaagattttaagatatttcaatataatatctaaaaatgaccacttaattttagtaaaaagagactcccaccttctggtaattgacaattactatggtctgagagtgtttagattaaaaaattgtgtgtgtgtgtgtgtgtgtaaaattatcacaggaaaatcaatacatcaatagtagcaccaaaaaagaaaaaaaaaaggaaagaaactaggtcctatttttcatgactaagaagttgacaatggtctttccaaattaagactcggcatctttgatttttgtaaacatatcctggagatcgaatgtgaacatttgatggctgatgggaagaattgaggaggattaggggagcacttgactttgccatgattctcaagttaaatccttggacctcttaaagatgttgttgatgaagctgctaaaatggtcaccagatgaatataaacaagtaggacccgcagtaatttccaggctaattttgtgcacgtgcgtttaggggcgagtcaaattaaatgaatgaggagctgatgttcatgtgaaagtaattactctcctccagtagaaatcctaatcctacaagtaactgcagaaataattaatcataactaagaagcaaaccactctcagggagaaaagctgtatctgaacttccacgtgctcttggaggatacgggtgattcacggcataagagtcatctaccaagtcatctgcaagagcgagtgcagcttccaagagggtctgagtcagaacagataaaaggaagttcttcttaactcagaagatttcaacactggggaagctcatttcccacagagatagaaaaatgtgcactataaatcactctcaaaaagcaatttagacaactacacaggtaatgataaatgcatggagagcactcacatgttttgggttgtgtttttgaccttcattcattctttatagattattaatccacggattaagtcattgactcatttatagtcatgagtcattaaaacttttctggagcatctaccacatgccagcaactgtgctacttagggtacaaaggtggacatggcccaacccctgccctcaaagaacttctagggaacactgactttgcaggcatgattccgtctgcatcacgcatcagtaaacagctatgtgtactgtagggtattgagacacaatgacgttccctctgctcagctcatcaccacaaccaatgtgtaggagcttgctttttgagacccagcggtgctttctataactggaagattccaagtttcctttgcttccatttatgcattcagcagacattaaggccctgctagaacctaggcattggcatgtacaagatgagatatggcagcttgcattccagtggaaggtggtggggtgtgatggatgaagagctggcttttgagtcagactacaatcttaaacattgtcgccactactagctagttgtgtgaccctaggcaaatgctttaacttatctagcctccatttacttatttttaccagcattactctgaagtgtggagttatacatacatgagctgccgacacagtactagttacatattcattctcaactagtggcagttgttggttggatcattattataattaaatatacacaagcaaaacagatatctctagtacactgagataaatattctgggagacagaagcataggcaatcatgtagagaaagccccaaacccatgggaacaggtggagaaagcacctacctagaaagggtaacaccccaaaggatagacatgagaacgctggccaagacaggaggtgggctttcgggcagatggcatggcatcaagtcaatcaatagaggactaatccatctgggcaactgcaagtcattctgcatgacctgaccaggtaacaacctaaggagtggctggcactaaggcaggtggggccagtttctgaagggtcagtttcaggagctgaggctttggtttgtagacaatggggccactaagctgggcggcagagtgctttagggacaccactgaggagggactatgaaggatgctatagagagaggacaacttgagatggggacctcaattatgagcctgtgctgtcatgcaagaaataaagtatgtggatctaaaccaaggcagtgtcacccaagaaagaaaatgtgtggatctaaaccaacgcagtgacagtgggaagggagaaaatggacagcttcaagggatgttggggtagactcggggtgctgagtatttttcagtgcctgagggtctacgggaggaagggagttgccctgggtaatggataatgaagctaggctgggtctaatttggggtgtttgtgggcaatcaaagggaggaaccacacacagttgactgttgttctggcagtcttgcaagagcaatctggaacacaaaaagtctaggcttcatgaactacaaaggtaacatctgaaaccatgggagtagatgcaggagtgtgtctttagtgaaaataaaatagttggagcatggagccttggagaaaatgccacttcaagattggcagaagaggaagaacctacagatggaactgagaaggcatcagaaaagtagaggtcaagttgagagaagagagtagcagcagactgaaatgctatggaaatatcaaggaagataaggaatgaaatgtatttgccagctgagttgtaagtaactctgaccaagtggagtggtgagctgagaggttactctcttggttgaagagtaatcacccagccctcaaggaagtggaagcaaagtatcgcttctgtcctttttaaagctcttctccatatcattgactctgctccccaaagcttggcttttagtgaaagccattctatttagacaaactcattgtctctcctctcaaccccaagacaagcattttgatctctttaactccatgggttttattaccaatgaatgaaataggacatggcacacagagcagacagaaggccattgccaaggtctttcaactggggtcccactctcaattttacttcctgaaagttcaatgtcttggctgaaaacagggctgaagatagatccaaggaagaccactgggaattggccaactaggtttaaactggggaacaactcccctcaagtggcaattttaagggtcttcatcctgcctcattggctttaatccctcttgaacatgtcaaagtggttggaagactgagtcctggtgggccacattgtgtttctgtggactgcggactagtttcagaggaagcacctgtctaacttaaccagggatcacttaggatgaacaccagttacacagtatagaagacataaatatttgaaattttatttgcagccactgttgcacagtgcaagctgtctcagaaattaaggcatatatatagttcaaatgggaccaaagtagtcttttggaagtcataatagggcacacatacatgaattgttgagcagaccttgtaaattaagagattcattgtattcaggcaatagtgtgtgggtgtgtgttcgctttctttgggaaaacagcatttgtaagccactcactcccaacatcaggggcacgtcagggtgagggtatatagaggtagctgttattagtgagaatataagcgacgcctgacttagcactctgttactgttagcactaccgaatctttgatgactaggtgtggtcaaaatcttggtttccagctatgtttcccataaatgaagtttccagatataagccaaatgcttaaacaaaattgctgactacaggatcattttgtaatactgtatgggtgatttataagctgtgtttttttaaagaatgaagtcatctagtggctttgaactttctccccataggtgaagttataagtccagcaagctcctcagtggctcctttctcaacagtcatgtgagagaagccagcctcaattaagccccacggcattcactgatggaataaattaccttctattgtatatgtctagagtgatgcttgctataaccatccatggaagaaatgagaacacagtcactcaaaccattttctgggttcagtaccgtgttgtccagatgaggaacagtggctgcaaaaggccgtttgctatgcagagtgtgagctttcacctccagcctcagcctcgcctgggagctggttagaaatgcaaattctcagacctactgcagaccttttgaataataatttgcatttaaatgagccctcagggaattcgtatgcaagtttaatcagtattggtgtgaagcaatggattcaaaaattatagcctctcgcagcacacacaaggatacttagggacatacatgcacaatatatacatttttcgtcttgctctaacaaattacatatattttatttatttttttcaacttttattataggtatggggtacatgtgcaggtttattaaacaagaatattgcatgatgccgaggtttggtgtataaatcctgtcgtgcaggtagtgagcacagtacctgacaggtagtttttaaaaccaccccacagccctctagtagtctgcagtgtctattgttcccatatttatctccatgtgtgctcagtgtttagctccttctattataagtgagaacatatggtatttggttttctgttcctgcattaatttgcttaggataatggtctccagctccatccatgttgctgcaaagaacatgatttaattcttttttatggctgcatagtattctgcggtatatttgtacaaaattttctttatccattctacatttatgggcacctggcttgatgccatgtatttgctctagtgaatagtgcagaggtgaacatacaaatgcatgtgtcttttggtagaatgatatagtttcctttgggaatacacccagtaatgggattgctgggtcaaatgacagctctgttttaagttcttttagaaatctccagactgctttccacagtggctggactaatttacatttccatcaatagtgtagaaactttccctttctttgcagccttggccagcaactattttttgactttttagtaatagccattctgactggtgtgagatgataactcttcgtggttttgatatgcatttctctagtgattagtgatgctgagcattttttcaagtttgttgactgtttgtatatcttcttttgagaagtgtcggttcatttcctttgcccattttttttaaatggagcaatatgttttttgcttgttgatttattcaagttcaccatggattcattttaaaatatgtataagatataaacacttaaaaggataaagtggaagctacaattgaatacttctatcattttgtcactgtccctgcttgggttactggtgtaccccacattggagacatctggtgtaaagaagcaaacagagccgaaaggaatcttagaactctttgtctatgatggtcagtgtactggggaacatgaaatacacagaggaagtaatttgttggatgaaattgaatatacttatgtttgcccatagtttttatcggttttgtcattttgagagatgtacaactaattttctcttcaagatagaacattgtggcatattctttgtgctacgaatcagaataggaagacgaaatctttatttctaattgaattgttcaaatcagtgaaatattcttcacccgaacaatgtgcctagctgtggactggattcctctctgggattcctctctgacctagaacgttgggcatcataaccttaggcaagtgacattcttactaaatcggacgctgagtccccttgaatggcatctctgcccaccgtgtgcctcccttaaacattaagttcctaccacatgccaggccttgtgtttgccactcaggatgaactactgtgcccagtctatggggaaagctaaactccaagactgatcattacagcagcacagtaagtattatcatgaggtgtggacaatgagaaggcagaagagaggaacaaggtgaacgctacctgcatgctggaggagatgacatttgagcggggcctcgagggatgcgtaggagtttaccaggcatagagcaaagaagaaatatggaataaaggggtcagcctaagcaaaggtatagggcaggatatctgctttatcagcagtatctctgggtgaagtgcaaactcttctaattcagtcaatgaaatgaagccttaagatgactgaaaactaggttcttggatttgtgcaatagatatttggaaatatctctgagagtaaatgatttcataatgtttggccacaacactgtgtggaaagtttctttgtgtaatataatacagaaagtacttctcatttacagtaaaatctggaatacttggaaatggtctgtgctagggaaactgaattttcagattaactgcataaaaatggaaaatctggttgaaaaaccttcctaattttgttttcctttagagagataactgctgttaatattttagaggtgttttattttgatcttacctagagagagaaacagagagattaccctgcatatttagctgtatcaattgccttttaaaaaacatatttagcattttttcatgatttttaaacactgcataatatttcagcctatgagtgttttataaatttaaaaccattcctatattgttggtgactcagattgcttctaatgttttaatatcataataaatatagagaacactcttgtacattatcctatcatacatttcctattaagtcttaaaagtagacttactgactcaagcagtctaacataaatagtttaaaactttgagtatacattgtcaaattactgcctccctcaaaaaagttatgctagattactctatcggacaccatgcaggaagctcttcatttctgcaaactcgtcaatgtagaatgttcacatgtcttttaaaattttcggtaatttgataagtgaaaagtgaattcctggtgcctttgtgtttcttggactgatggtccctcctcagtctcctttgcctgtatctctgactctgcctggtcttaaggctactcaggctcagtctgggttgctgcttccacactactgtctaagggggaagctcctgcactttcatggctcaaattccactcgttggcttatgtgctaaaggcatccctcctgtccaggtgtctctgttgaaggccaggcccatctgcacagaccctagtgcttacttctctttaggtgtctccaggcagcctccagtgcacaccttcaaacctgcaccccagaggtgagatcctccttctgcatcgggattctgcacaagcgtgagctccatgctggtataacacccaaacattcaatctgggtgtcccataacatgtgcataatgttaaaattacagaggaagatccagtgtcctctgaatcagtaagatagcctccgcccaccccaacacacctcatttccatgccaggaagcctggagtcatcggtgagacttcctcttctctctgccttgtcttcttaacatccacctgttggagacgcctgttgactctgtctgggacctgtcactcagagctcctggctagtagctctcaagctacaaacaccgcccttgtccatgcatcagtaatttcaactcagattactgaaagtgccgattaaacagactctcagcatctatgtttgactctttccaatacattccctatgctgcgtttaacatgatcactttcaaaagcaagtttgatcctttctcttccttgaataaaaccccaagatactccttgtgctccaaggatgggggtgacggtcctcaaggagcccacaaagccacatgcaggggcatggcatggctctgcccttgctcctacctgacactgcttccctctcgcctactcaatatcctcctcgtttcctggaaggtgccaagctccatgctccaactccagactaggacatgttatataccccatgtgctagtctctcatctatccttgactttctccccagttcttcccacaaatgtctttaaatcactcatctaatgatgtatttaatgcctcttttccctgttttcttgcaaactacccaagagcaaaaaccaagtcactcttaatgcttcatcagcagcatcctgtgccatgcttagcacatagttggtgctcaataaattcttgccacacaaaccaataaataaatgttaaagtgttgaaatgtcttttcaccttttcaacattttttgaattgcgtttctacacacgttgcccacttacgagaatgaaggctcttgttgatttgtgaaaactttatatgaaccctctgctgttcatccgtggtaaatgtgattccttttgataagtcgtattttatgttttatttgtcgtatgcatatgacaataacagttaacacttgtgtaatgattaatactaatcattatactaatcatacgagcaggcagagttttatggtgctttatatgtttttatttcacgtgaccctatgaggcatagaaatgatcatcatcgccattctgcatatgaggaaaccgagtctcaaaggggttaagaaagttgtccaaagtcacacagctggtgttaacagaagcagggtcctgtgctcttaatctttacgctatactgcctctgaagaattgtttaattttttttaagtacagaagagataatgttcaacctgacttttgaaggacaggtgggagttaaccaagaaagggagaaaatgaagaaccttcaggaaggaattcatgtgccagatgtgggctgagagggcacccagctgctcaggaaggggcaagtatatacccaggctctgttctgaggtgaataaagccagagagggagcgagagccagggcttaagggtctttttggttttccaagttgttcaggatttgtcttgtcagcagtgggagataccggaggatttatgaaagggagtattgtctcaattagtactctagatgagtaagctttgtctttcctggtaagaattatcttgaaaccatggcaatataaagttgcatgtgactgagtggtatattaactgtaaaaatccaccttcctggctgggcgcggtggttcatgcctgtaatcccagcactttgggaggccgaggcgggcggatcacgaggtcaggagattgagaccatcctggctaacacggtgaaacctcgtctctactaaaaatacaaaatattagctgggcgtggtggcgggtgcctgtagtcccagctacttgggaggctgaggcagaagaatggcatgaacctgggaggcggagcttgtagtgagctgagatcatgccactgcactccagcccaggtgacagagcgagactccgtctcaaacaaaaaaacaaaaacaaaaacaaacaaacaaacaaaaatccaccttcctacttccgagaagtgctacagtaaggctatgaagaccaagcattatgtatgtatctgagctgttttctgttatttccccctctgtttttatgtcagaagaaactgtaccattacttctagagtagaagatgttggaatgtctcctcattggtcttactgttccaatcacgtgagcaccaatgtaatgttcattactaacattagtgcctgcaagaatatcctactggaaagggaattagctgtgattttgttaagtgtccagccaattttcataaaagacacagtatctgagatggctgttaaacatgtcaagagattgtgtacgaggggaataaatcaaggaagactctataggttggtctgattctgtgatattaccagaattactggtaatatctacagcatttagaaacttcatccacagtcagatttaatcccagggctatgaagcctggagaatatatgggtagaactcaggagaatccacgatctcacatgaggagaaaagaacagcagtttattttagatggcctctaactaaaatttgtattgagtgtgtgcagcaaaccacagatgtactagctgcaactgtgactttgtcatagtggaaatcacagacatttcaatatcacattccagtcatttcagagaccttgaaataacattgctgctcaccacaccttcaaaacattagctctgatttaatgcttggaaaagtataattttgttttttcagtactgtaataggtgcattttaatatcattggtgtcttctgtaatctttgtgactttacttttatctgtttaaacactttattctgagaaggcaggcatgtgtctcactagtccaccaaaaaagaccataacataaaatgttaagagcccctgagctaatatcttaaaaatgagacaaacttcttagcttttctgacacctctggtaagccatgcatgaaaaggctgcacccccatcccgcagtggttagatttgttttcagagtttttagtactgggaaaatctggattgttttttttcttctaagaaggatggctttacgttaaaccctgtctttaagtttcttggccttaggaatgactcttgagcataagtttgcttttccctagggatgccagatttagcagatttagcaaatacaaatgtaaggccactctgtactatgcaaatctatagatacatatatgtaaatagtacatatgtatctctgaatttcaaataaacaatgaataattttagtataagcatatagcaaatatagcatgtgacaggcttatactaaattatttgctgtccatctgaaattcaaattcaactgggcatcttgtattttatctggcaactctaaaaacaccaaatttgggccaatagtcctccggctaattaactacagatggttagaatgtgttttcttacactgtacagtgatggaaattagttaactgccaaatgtcttaatttttgattgaatgtgaagatatttttaagtttgaaattttgtattatcattcagtgatcacagagtctgctttcaactttgggacaagcaaacaactgagaaatactaccagtctttaaagcaaattttggtataaactgtgttccactgcgatacagtttctatatcagagaaatgtggtcaaaatgtagactgatagtgagacagaatttcaaaactttttgacatttgtcccattgttaaataacttgtttttttctttgttttttttttttttttttttttttttttgagatggagtctcactctgttgcccaggctggagtgcagtggtgctatctcagctcactgcaagctccacttcccgggttcacgccattctcctgcctcagcctcccgagcagctgggactacaggcacctgccaccacgcccggctaattttctgtattttttagtagagacagggtttcaccgtgttagccaggatggtctcgatctcctgaccttgtgatccgcctgcctcggcgtcccaaagtgctgggattacaggcatgagccaccgcgcccagccataatttggttttaaatcaagcacaagtcgtaatttccattgcctgggatgagattcatgctaataactaatatgaatgccaatgaagataagaattttacctttgcatgcaggtgaattacatcagagcccattagtcatcaatttgtagagactgacaactccacatttatttcaaataaaagaaaatgtagtagtcagcatgaggccagaaaacaagccagcctgaaattgttacccatatttataaaacatactttctatgtttccgtgccttcatcgtagtgcaaaatattataaatgtgaggcaaagaaagataaatgtgagtggtaaaaattggcagactcaacatcttagtgagagagatagatttacttaagggaaagtcagtttggaagtattgtaaattatataatgatatggcataaaaaggcatgatccagtctcaagcatcttcttatgtctcacagaaacaggagttaagaaaaccagcatcactgcttacttcccacgtgtcatctcctgtgaatgctccaaccatgtccactttgaagtttcattaaataaaacacattaagccgggcgcggtggctcacgcctgtaatctcatcactttgggaggcggaggcaggcagatcacttgaggtcaggagttcgagagcctggccaacatggttaaaccccatctctattaaaaatacataaattagccgggtatggtggtgcatgcctataatcccagctcctcgggaggttgaggcacgagaatcatttgaacccaggaggctgaggttgcagtgagctgagatcgcaccattgcactctccagcctcggcaacagagcaagactgtctcaaaaaaaaaaaaaaaaaaaaaaggtcaaatacttgcttctctaccagtattatctgcaaaaacagaagccttccactctgatttataccacagtcagacaaacccaaacgctgtggatttccttctccttaaccaaatggtactgttttgagccatcttctcctctgttgtaggtttggactaatccagacaaaaatagtgagtgagattccactagcctgttgaagaaatctctttcctaaggagaaaattgggaccaggagcagtggctcacacctgtaatcccagcactttgggaggtcgaggcaggtggatcacttgaggtcaggagttcaagaccagcctggccaacatggtgaaaccccatctctactaaaaatacaaaaattagctgggtgtggtggtgcacacctgtaatcccagctacttaggaagctaaggaaggagaatcgcttgaatctgggaggcaggggttgcagggagctgagattgtgccactccactccagcctgggcgacagagacagactccatctcaaaaaagaaaaaaagaaaattgagcagtgcattacggaggctgacacagtacaattcgcctcctcaccccctccacactcacttccagacatcagtgttcctgttttgccagtcatctcacaacaatgcatgtccaagccacgctgtgattagagggagaatatgcttattacccaagttcttcgcatgttggagcagggagaggccaagggtggtaaaccacaggaaatttccatttgccctccgctgcggcactctcactctatagggaagttagttgttattaggtaataatgttcagcggaggttggtcactcgtaacaacagacagatgtgtaatgttttatttgggttagccagctctctcacaaataaagggcctgaaattaaactgtctttatgaaaatattcagtaaatgatacctctggcttattccagtgctcagattctttgccatggaaaatggcaaatgagtcccctgttgggcccggaatctgtttaaacttgtctttgtcgagtacagaagggttgatgttctatgagattaaaaaaaagtttttaaagaattcgcatcgaggagtaaagggaacaacgatgcaaaccacatttagagatggaaaagaattttttttagtacttatggaatttcaaacaataataatggaacagaaacataggaaaaaagctacatatctgaccacagaggcaaattgcattattacatgctcacatgcaatgcaaatgtggattggtctgtaaaggaacactttttgcttttctaatgtatagtagggtgagaggagcacctctccaatttgccaaggcatcactagcaaactccagctaccgaattgcttggggaaattgagttcttttgaagacaggttcttgggaactgtaccccaagaacttctggttaagtagctcaggtgtggagcctgagagcctgcatttctgacgatggagatgctgcggttggatgaggggagaagggtcacactattctataccaccctgtttccagtagccagtgagatggataactcatctcaacatagagtgtgaccacgaagagagatacctacccgtaaaatggactaagattcacaaaagcttgtttccagctctaaccttgttactggctcagtaaccttgaacaagttactcaaactttttgatccttttatctccctagatataaagtgtagagtttagaccagatcagcactcctcagtgttctcaaatgtcataaaaaggctaaacacacacacacacacacacacacacacacgtatatatagctacagttaagcaggttttataactgtaggacgtctcagaaactgtaataaacaaatgtgcaatgtggctctccaaagagtgaaaacaatggggtgtctgggggctcagcttcagctccagtaggcaaatccttccaaaagtatttaaccacaaattcctttatgtgtatggaacacctgaatcacacacttcagcaagagaacccctaatgtcctccagccttaactttcccatcctagaatctaggttctccccacagtcctccaatgttcccagccaggccaatgctaaaagcttcccttaatgatacccattatccaaggaagaaacctgagagcaattttctactacctgtttgcttttttccagcaattctcaactttttgccaagacattacacccgaatttctatccccaaggaaacattttctaactaaaaactccacctggccactgcagtacttatatatttaatcccaatgactttctccattcctttgtttgaaagtaatgagactaaattttagacaatctaatttcttggcttattcattttctccatattccagataacttttaagtggtgaagagtataaatcgtggttttccaagtgtagtctaaggtctaacagcatcggggatatctgggaaattatcagaactacagaccctctggctgcaccccaaacctgctgaatcggaaattctgaggtaggacccagtcatttgcatttttatcaacccctccaggtgattctaaagcacactgaagttagagacacagtgttgagatcagaagcatggactatggattccaacataccttgtgctatatcacagttcctttgtctgaaatatgggaataatattagtacttacttcagagtctatgtgagaattaaattaatatataatacctaatatcaggcctggcacagggtgagcaatgagtcaattaattacagctgcttaatctataatggatgctgacgcgtagtgagcaggaacttagctttgtcacactgcaccacgagactcctttgcaagctaatgctgatgatggtggttagataggagtgcagccgtgggagcagacagagctggtttgctcaccaggtgctccatgtattagctttgtgaatgcatgtaaattatttaatttctctaagcttagtttcgtcacctagaaaatagagaaaataatttctccccaaggtaaagagagggattcaataagataatatctataactgctttgaaaagtgcctggacccttttaagttgtcccttcccaaatgaaagctatcaatgacctaatgacagtggtacctgggcggcccagtgtgtctatgtgattacagatcctgaggccactaggtccttaaacttgggcttcttgctccacaaaatattagaatgataggatatgatacccttacaactttccctaaaaagctatcttgtcatgataaatgtaaatattgactcagaagtaatcaaaagataattagtcaccttttctatgttgttcttagggataaggcaagccattcttgccattacaatcttgttgaatttgggttctttttgtattcagtgttgagtcatagaccaacattcagagtttacattaagactatttcacaactcagttgggtgcagtggctctcaactgtaatcccggcactttgggaggctgaggtgagcagatcacctgaggtcaggagttccagaccaagctggccaacatggtgaaaccccatctctactaaaaatacaaaaattagccaggcgtaatggcgggtgcctgtaatcccagctgcttggaaggctgaggcaggagagtcgcttgaacccaggaggcagagattgcagtgagccaagattgtgccactgcactccagcctgcgtgacagagtgagatgctgtctcaaaaaaaaaaaaaaaaaggaatatttcagaactttatatctttcctttaaatgcagtaccttttaggtcaggcatataatcctaagataaaaaaatatgtattaatcgtgaaaatgtctctgtggtcaggtttcactaggttttgccttgttaacaactctaagaactgtgtggcttacagcaacaagaattttttctcacctgtgtttcaagtcagctgtagttgaattatggctcagttccaagtttccttcttcccacttaccagaaggaaggaacagcccaatccatgacccacccacatgcaaggcaagccatgtgatgatcccgacacctctcttcaggcatggtgtgggttactgctgttcacactccattggccaaagcaggtgacagggccacacctgacacaagggagtaggaaacacacaccccacccccgctacgcccgggcagggaaagtcccagtgaaggatcctttgtggaaggacccagccgagaggcacagcaaatagttgggagcaacatacatcaaccacaacctcccaaattgtcacagctctaccaatagtttccaagttcaaacacatcttccaaacacaggtcactgagaggaaactagcttccaagtgtgctgtaatctcaactggtgcttcccctgaaatcctgataattcccctggaggagaatgagtgattcttcagcctccaaggagctgtcattctttctgggccatccttcagtcctcagtagtctaaggaaaaagtgcttttgcagaaggaaagtagaatttcctcaggagatacaaaccgaaggattgccctctggaatctgctgagaatccactttgtccaccttgcttgttttcaatgaacatgtctgtttctgaggccacttggcaaagctatctgtgcccttggctggtatggatgagttaaaagctggactttgtacagtcagaccagcctttaaagcggatccttcactgctgcgtagtgtagggaggaaaatggcccaaggccaaggccaaaggtcatggtgcatgtgctcctgtgaccacagtcgagggagcccagggaggagagctaagcctttattctcaattgttttaagcctcctgagctcagtgaaccccaagtagattcttgtcaagcattttttttctacttaatatttaaaacggtgatacttaaagtcaaatttaatccaggcattttttatttctggacaaagagatcattgaaaaattaatttgtcagaaatatatgacacgcaaaaaagcaaaaagctttttaagtaacttttcttacaaacaggaagctatgttttttcagagcttaaaagtgagatccaccacaagttaattttagtctagaaatccaaagttactatttgatttagatttcactctttatgcctcatcaccctggttaaaagacgtggaatgagctcgctgaaggcctagttgaggaaccccggttctggggagccactgtctccccatttttctgtaagtgagaaatgttttttctaaggggcctttgctttgttagttcactgtgaaacgcagaatgaagttttctcgagatgggcaaattgaaaatcttcaaaatctggcctaacagagctctaagttttaaagacatcaatgtctttaaacattgccatcatcaacatggcaatgggtactacccttccatttcccattatccttgctgtgtccccaacactggaagtgtagttctccatatagctaagtacctttttcaatgtgccttctgttccattctgtttcagagtgtgtttattttctttcctttaacttcagaaaactaatgctcacagcataagcactcagtgacctcagaccattaatcttttactggtttgaagtaggagaaagtaatactgacctatccattcaatagttgtaagaacttcacttaggtagatatcgccattctaaaaattgcaaccccaacccacaaactgaaacgatataacaaaaactgcagaaataaacattatttccagaaattaaagaaaactgttaatggtttatatgaaatattgcttagctgggaggattaacccttttctcatttgccctgagaatactcactggcagcacttgaggctgcaatatttacctggagatgattttgccacacagtatattacttttattattattttcatatcactctagtatatcaactttggaaacaaaagacaacattctatttagagcattctgcttttagtagtggtatttttatttacaaaatatagtaattcttgatcgctgaaaatgtcaaatcctggaaaacacagcattcctacacatggtgttaacattggtctccaacagttgttggccagagattcatttgatgaatccaatttttccgaaatagacaattctgatgattcagatgattctgatgttagttctgtttagaaataactccaagaacaatttttatgttttactttcacattgaaaatcaatcagatttgcttcagcctcgaaaagcatgtttatgtaaaattaagtgagtactggtggcaagctgcacttttttttttaatgggaaaaaggttaagataggggaaattagaagaaactattcttctctcattctttgtgtttttatcttttggaaaactgttattgttgcttaccatgttagaagttaagccaggtctattgaagaatcactaagggaatataacctaaggcagtaacataaaattatatgaaataagagtatgtatcaacactgattcaaacttcatgaaagaagtctgctgaggaataaaattctataaattaagagcctatgatgaagtgcaattcataaagcctatgggtaagattgatgggcacaaagaagattctgggtcttaatagagcaatgacaaagaggtcatttgccaaacatgctgtggccacactggcaggatccagcctgtaagaggatgcacaggttaattgggaatactttaactataagagagtaataactgtaaataattggcagatcagaagaaacgtaggaagtataagtgtgcctgtgtgtgtgtgagagacataaaaatatatggatgtagacagatggatgattgatagatagatacagatcatagataattgataggtaatagatcaataattgacagatgatagataatatgcaggtagatatttagaccggtaataaatagatagataattgatagataatagattgattggtgatatataataaatgatagattagagagataattgatagataatagattgatagaagatagataatagataggcagatagcttaggaagaattattttcaaaaagtacatgcaaaagaacctcttgaatttaaaggagattacatgaaactgtggatgtttaaggggattttgtggtggactgacaggaaccctgggctagcttccaaagactttggaccttgttctttctgccaggacccagctgtgtcaagtgggatggttctgacaatcttttccactctaatgtcctatgactcaacagtagcaatgcatttccacaggcggtaaaaatattctagactcttcccttccagcgctcactgtttacttcctctgcacttccccttcctgcctccccgtgtgccggtcagttcatagcgggcctcaatgagggtgggttaaccctctctttccagggtgttttgctacggagctccctccaggggctgggaactgtgtggtgagggctgtggttggggttcagcttccttcttaaatcgttccttgaacctttaccctattctgtgcactgtgccgatttccagggattggaaggtaaatgccactgcgtaactcttagaaaatcatcgggggtcagttttactggggtgcacttggtaaccatctatgaatccatgtgtccctctttctttcaggcagtagcagaatcccatggtagccaggtgggtgaaggggagcgaggacgttctacctgccttgaagaagacacctgacctgcggagtgagtgaccaggtagtagacggttctgagggcatcacacacttgagggagggaggaggacagagagggccatggcaccctttgactgctgagtgccagctgctctctttcccactgagaaatgctgcccccaacacacccagaggctctaggtcttgtcctgtgatttctgtccaccaagacttgataggaggtatgatagatgccattaactccagcactatatacacaggactgcagcaaaagcgctctcagcagaaagaggaaacagatacagttcatcccaagcctggcttgctgcccctttgaaagagagtttcaaacagaagcttcatggtgctgccttcataaaaacagggccaagctttccagaatctggcagagggctgagtgcccgcaggacacttgtgtatcactcacactggaaaacttaatcctctgtttttatttcagtggattgaatggcatgcagtttcctcagcagcttaaaaaaaatgcatgcagtcacttgcagacaggctgcatttgtctctgctggtgctcatgttacaagtttgtctgtgcatttgggcatgccagaatggcgtttcatttccaaacctttattgtggtcactttcctcttcgttacactgagaagtgttgctgagggtatagtaaggccctagttcatcaattatatcctgtacttttcttctaacttgatcccaagaacagtggaatttgcttcaaggtaaacaaattttgaataatttatggcccttcttttcaacaaaaatgaaaacgtgactttctaaagaaaagtcaattacaagggggcatttagtaaataacacactcttaataaagtaacaggaaaattaaaatgcccagcagacccattgcctcctgaacaggtgtttgctgctaatggatacagtttccatttccttgaagggatttgcccagaggattactttcacaacttctattgagataatactgctctaacagaaagagcaatgcatgaatctgtatatcagttccttaataaaagggaagatttttttagttcctaaaataccaatgaggtgaagaaaaacatgccacccaggtaaagttactctgtaatcacccgcattatctttttcaaggaatgtgggggaaatttatgtcagtcatcaggcaggtactagaagatgctaggggcctcacagacagcttgttcccggctgttaacatggagcagagcgttccctggggctgagcatgggagcccagcacttcttataggtaggtctttcctactataatattagatgcctacacttattgactttttcatttgctctttaaaatagatttcttctgctggttctgcttagttctaaggagtaaggtagaattttggtgccatacctaaatatcacgtctaaaatgacattggtagcacttttccaagaataaccagcatattgatcaagccattaataaagcctaattatttgctttaagaatgtttttggttgtttcaaactgagttttttccaaagtcataacaaaactaggagaggctgtagattcttaattattcattagattagggggaaaacgaattgctattacaaagaatatcatgcaaaaaataggttttaaaaaatgcattactactgagttttaaaaatgtatactaacattctccatatcaagaactgtttcatggatggtagattttagttatagcagtactggacttacactcagtcaaataattttaaattttctataattgggaatacatggtagctgaatataagcaaacatattactctatgaaataaatgcataagagtttgttatcacaaaaaacagcataacattatttttttgaaacacaaggctctgttttaacactttaccttgtttaatagtaacaaaacccctgaggaataggttgtattgccattttaaacactggagagcaaaggtccagagaggttaaatagctttctgcaggtcacacagctgatgaattgcagagtcagcatttaaccccggtctgcttttctgcaaagcctctgctcctcactctaccctaccgaccacctaagtatagatcagttaatcttgccttcagaattctcctttcttgtgtacttccatgtacattcatacttacttcacatgatgattctattttctggaagttccaccacatatggcgataatgaaacatctttgtcatttctctaagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtccaa

SEQ ID NO: 1018 - DNA, 44878 bp, Homo sapiens
cctcctctgcccaatgtctcccaatctctttcctttctctcttcagttcctccaggtaattcttactcaaacttgtaccaacttgtttttgactgacagtgaacagtgagagagttttcttcattttgaggaaccctaaacacctatctttcccaaggcaacctgtctggactgagcatttctctgacttgacataacttcccatccagccaggagtctgcactcttcagtctttgcaggtaagaggtacacggcgcttatgttaactctggggcatgtggcacgctggaggtatttttgaaaaactttacttctaaaggtaatgaaagcgttgtgattcttttaaagcttatttaaatcatttaagacgcccgtgcttatctgggggaatttacaagtgctgtttgcatgtggaaaacgggattttacttaatgatgggacaaaaaaaagtgttttattcttgctcgtgaaacaatatccagatgtcgtcttgtttgcggtgggtgtacgggggtctagcttgcgggacaagaattactccgacttctctttgcaagggtctgtcagagcaagtttgttgattttcagcgattacatagttctttggctaattctgaagcagttactttcctttgtcaatggggaaatcagtttagattgccgtaaggcgaaacctcgccggaatattttaaaatctgttacctatccttttgagaaaagttatgtaagttttctgtggtaggtgtaaggaatgtaaacgatcctgagtttggaaatattatgaactttgttcatgacccatgattaatatgttttttaatctgtgtataatttcatgagagtttagactatcctcagctaataaatgttatactgggtgaaatttccacattgctcctgtaacgccaacgtttgtctcctctgtacttccgcatttagtcacttgaaggaaataagaatttattgttcaatagacatttcttgacctcataatttcttttaacccacaggttagaaaacttacaacgaatgtagtatttgactgtggaaaactaaagaccaaaaatgtgtaccattaattcaaatgtttagatttatctttttcccctttacctgtaagagggattttgaaaaaaaaaaaatccaagtgattcttaaaattcattttttgcaacctcaagatcacaagcacacactcacactcatgcacaatcaactgttatccccaatcctatcttcttttgtcctcttgtgaatgtttaaacaaatatgaaacaatcggtagtaatagccttaggtgacaaattctctcctatttaaaattgtcctaaaaatcaaaagaaaagtgtcccataaagctataatacatttttaaatatcatcattttgtgaaaactaaatacagtatcagagacacttccagccgattaattaggtaagtaagcacttacctcacacacagcttccccgggcgctgttctttcttcccataccttctagggttttactttttagcagtttttctccttctctgttaatataataagtgaccatccagggaatggcccagaggccacaaggcaagtcttcccaaaatactgaagattagaagagtttaaccaaattcctggtagcagcatgtcagaaacgctcatcaaataacggaacagacctttcttcactgaattaaataaatgtataaatagtctgggggttttacagaaattgccttagttgaactttgtgattctggttgcttaaggaaaacacatttttctaaaacgtcctctctccatgtttccactccttcctcccaccaacagttgtggtcattttacagaaagtcttatttccccaatttcctctcctcacacttctcaccagtgcagacagccagtgttttggggggaaagagagcgagaccccaggctgcacatgccagcaaacctgagaagccaacaaaagcaggtctctgggctctttcccataaggctcagcacaacctcactctgcttctgcatcgaggaaatctcgaaagggctgtgctttcttggggcgtgtgtgtgtgtgtgtgtgcgcgtgtgtgtggtgtgtgcaattatatacctgaataacaatgacatactcgttataagaaaactcaccaatatgtggctttaggcacggaatagagaggcaaagttattcggatttaatcagtacatgtcaaatctttggaatatcctttcctgtgcaatcccctctcatctgtttagagactcaaagcagcccacgaagttttttgcatactttgcctcagagtccaggattgcttatgaaatgtatttgtgtggtggatgcgtcagagtcttagagccaacataagagtccagagactgagctgtaagcatgataaagctgtcaatgactggcccgtgggaatgcttgttgaaggcatatacacctccctaatcattttcttcagtctttaatatgtaagtgatacagctaccgttatttttttccctgcagcaattcaagcattgcaccccggattaaatcatgtatctctaaatatgttgttttaattctttcaagtaaaaataattccacaccgaaaattgtcagaaagccattacatgagttaatattaacttttatgtctgcaaagatgagtttgttgcttattcatgggcaaatacaagaggcaagtcagacagaggttattgtctaccttctctctcttctgtcctttacctttatctcataaaagccacctcaggagtggggcttttggtgcagctgatggtgggataaggccggggaagtctggatctagaacaaagtgaaccaagggtgagccttattctatgcccctcaaggatgcagtgccctggaaggagacaggtctgactgaacacacctggctcaggtaacttcctggtgccagttttgcagacaggtgaaggagcagtgtgacccggtagtagctccagagacaagcaatctaagaagtgctaaatcttccctaaaagaacacaaggagcctgctcctacctttaaaaggagaactaagggcagagagggagagaaactaagttataatttataaataaaggtttataaacatttaggaaatgcaacttctttcttggatcctttatttataagttctgacttagtttctctccctctatgcccgtgattctccatttaagaagttttatttgctaaatattactctgttgaaatgaaagaaaaaaatgagggggtagatatttctgataaaaaggccaggcgagaaagttgaacttgacaggtgtagcctctggaacacgtctctggatgaattcagatgatagtagggggatctccactcatcgtaatgcagctggaatacacatagtgaattctgtcacatgcccagggagaatttcagtcagaaacatctgtgctgttttcacaagggaaaggtcagaactccatgagtagttcatgtgtctgcatttcttttgatgggcattgtgcctcaactagagaagagatcaataagccaatagccgccactatccaatttgaatccagaagttcacacaacctaattccagaatacagtttgtgcttctagatgaaaaattctaaagcacaagcacacaattccagatattttagccactatacaaagatgaatcagggtcacgtgatcatgctcacgtcagaagatgcaggagaaggacaaagttttgcattttggtacaaaacacgcatgtgccagccacccgattcgtttccagtagggagcagttgagtggaaggtcatgtctgcactaccttaggactgaggacctacagagggaacactggaaagaattagcaacagaataagccaggttctgtttgattctgtctctcccaccctgcagctccaattcagagcagtcttaatgtgcagggatccgcatagaaccagccaagcagggcctctcgtagtagcctgaccagaagtcacagaggctgtgtaggccactcattccctcattcagagttcagacatcctgagcctgcccatgtccctgagattacagataacacgaatcctcagagtcaccgctgggccatcaaagaaaaaagagggtgacgcagagagggaacactgcaggggaggaatgcaattcttagggtgctctgaggacccaggtgcctgggtttgggtttcattcacatcctgcttcagtcggagctgccctggtgttgggcggatggctatggaactcatgtgcattttctttagtgtctacactggaggctgatgaagattttatggacccttaagattgcacaatttgggggctttctttagagaaaacaaatgcaaaattaggactgtactattaagtacaaggatttggataggacctgggcaagtgaggaaccctgaagctgaagtttcattaacttcttgataaatccactctgtgtcatacatagtaaagccctgatacttgtctcttgaatgaatggttgaattaacttatgtaaattttagctgctggctgctctctcaataactctgaaaaatgataagcaaaaaatacctatcatgtttatccatatctagtgatcagtgatatatggaaaaccaatcttaatgctatctagaatgtttcttgtttcattggcaccttgccatgaaaggtaggtccttgtactgtagttgaacctttaggtcatatctcagctcaagggtaagatgctatcaaagctgcttttcctatggtagaatatgtgagtactgaaattaactgtgcgctttttccacctgaaaagcccccaacttaaaacctaaagaacgttatgctagttgtgccactagaccctagaatggtattgaatgcatgaataataagcatcttcctgagcagacttgagggcttgccccagtggaatatctgtgtctttggtgagaagccttcctcttttttccttagtttctattaacgctgtttccaattttcaatagcagttaattgtgtcatttcttggtagaaatgctggctaaacccatgcctaccaagccaaataatgttctcactcaatgatgtttacattttcaaatatttgcagattgatatcttgcttcatcttagacctctttgccaaaaaatacaaggtcagctccctgaatcttgctttcttatttcctgagttatccttcatgtctattccaacctttaaaggacaaatttgaaaagtttatcctctgctttgaaagtttatgaaatttgtcatcatttgtactcttcctaccaacgccattctcacatatctgctaggaggtaaagaaaatataatgaatcctggagcacctggctgctgtgactagcatgctctaaatactaagaaataagaaacctgccctgtcttttttatattgtcagaagtttgtggaaagaatttatatatggacagtgagctgtattacatacagacacaaacatacaagtgacaaaagcagtgtgggtgtgtatttagctaggacattaataacaaaactgactgtgtaggtatagagaggctatcccaatgtcaacaacatcagaatacaatggtactgtattttgaacgtcttgtttaatatatttcaaatctataattttgacttacagtcaaaattaaacattaagtgcacacaaaacaattaccctttaaacagtatttttaaaaagtgatgtcatagtgacattgacatctgacatctttttttttttttgagatggagtcttggtctgtcacccaggctggggtgcagtgatgtgatcttggttcactgcaacctccacctcccgggttcaaagattctcctgccttagtctcccaaatagctggaattacaggcacctgccaccacacctgcctaatttttgtattttcagtagagatggggtttcaccatgttggccaggctggtcttgaactcgtgacctcaggtgatcctcccacctcaacctcccaaagtgctgggattacaggcctgagctaccgtgcctggccgacattgatatcttaacgtcactccttaaaacgagttggatataatgtcaaacgacttgattcttgtcaacaggaatgctgtgataatctgattacggaagactcagggtcttggttcctaggccctagggacagaagaaggctagcttctcccagacaggccaaagctgctttgaggagggaaggggaggtgaagtctccactccattgccagcaggacacacctgcctaggaactgggggagaactctcagaggctgaccctatacttcctgtctctggagtcaggggacaggggtgattctgctggtcagaaggcaggagggagtgtcctgaaacacaattgaatttgacagcaaagcactgtctatcctgggaagttctgctggtgagcggagtcctgtgagggtcctggtaaccctatccctgcaagaaataagaaggtctgcactcaaataggttcagaaaacctttcctagtttaggcccctcttgaatcttcacagcaatcattaacattttaaaaaccccaagaagttctgcagcaaagacgttctttaactttgaatccaagttgtacatccattttggaccgcagaactgtccaccacctcctccctgaccacaactatgattccctcctctgactaacgtttcacacaaccccacgggggatgctttggccaactgtgatgggtgtggagtggcaaggcatcgtgcgatccaaagaacatgtgtgatgtccaggctccatttaggtgtaagttgtactactggggcctgactacctctgcatgtgactggccagccttcgggattgcgaagtggctgcttacagtcagccccaaagaatttttttttactttctttctgtttctttatgtccaccttattcctaaaagaatttaagtgaatttacaaagatacatacacacacacacacacaccatgaaataaaagaggaggaaaataagagtaaatgtcaaaaaggccatttgattaaatcatttacttacataaatttgaactatttttaaaaatcacagttgagtgcacacagatccacagtgccagaatcttacttttgagctcaacattaaatatagatcttaactacatctgaacttaacttagcttcctatttgaacctgggaatcaactgggcactcactgaatgtagttttacacgcactgtattttacaattcttttgaaagacaatgtccattttcctctgtggatcttttaaattttatttcaccttttacacccctttatgtataatttgtttatactgagattgtaaactttcttcattggcttagactcaggtctggcactagcctaagggactaatctctggtccatcaggcctgggctgggaaccctctgtgggattccctccccattcccggagatagctggttcgccctgcttggccccactttacaatggcctgcttacttgtcccttttccctacagggctgcaaactctttgacaatggagattttatgtagttatttctttgtgctttcagggcatggcccaaggtattcttcaagcaatatgtattgaatccacaggcactgacatgaaaggcataatttttgctataattacatctttactttcaccatgaacttacatctacctcatcctgcaaacgcacagcagagacctttttatctgaagtcttttgaaaatatgtgtatgtgaaaatggctaactggtgtgttctctcccttggtgaatattacaaagtgatagattggctgctagaattgcgtaagtggggttattaaggagggagacatcttattaaggagtgacaagaaacagggaaccatgtgcttaagatatagaagttgtgtaaacccaacagaggagaaatagaaaacatgcaggttattttggaaagaagaaaatgaagacacttgaaataaaacagaaaagtaaatacggagccagcagggttcagcatgggagtgtgggctggaagtctgattctgaggaagaaaacaaggggaaaaaataaaagaaagaatatactgcaatcccaggctagaaaggggtgatttgatccatggagcagcaaatgcagaaaacaacaaaattagcatcatttcagtctccttcaaacgctatgtctagatctggcttgtgttagcatacctgtggcaataaaggtatttggctctgaatgtgttttaaattttaaattgaagagaattttctaacatttacccattttaaagatgaaatattataggactaaaacttgtaagggccacttttctgtgattacaatcaagcgaatttcattgcagctgggagcagcctatgccagtatatggcatttcagagtctagggctgcataaggatatgtacatttaaacatgaattgtataattatggatattaacatgtctagtccaatatcctgggaatgttccctaaatgatactttctgcacagcactttgcttagttttcagtatctgaagaaatggtctgacttgctagccctgtggttggtagaaatgtatatttgatgggtttttaaatcaactctcactcagattttgaatagtcaggctttaaccctcagtgatcttcaccaagtatattcttgccaagggcttactctgcaggaggctgggtggtccgtcttatgtcgatttagaagatataagtgacatcaaggactcaaggagcctccaggctgctgctggacagaggtgtggataggaagacatggaggtagagaaacagtaaagaaaaacacccaaagcacaagaaaggctgcagtgtccagcagaatgtgatgacattgacatgagaggccctgacaaagttccagggaaagtcagagagggaaagaccagatccctttgggatgactgtaagaggcactgggacatttgagatgtgccttgcagaacaagacgacttccagggtcaggacggggagaagccttcagagcaggaggagttaccatgcaccagcaggagggtgcgggaggtcggcagtgtgcacaggggctgagcttactgcagggaaagaatgggagagtgagggccacagtcaggacaaagctggcagccaacagtgctgagcactcctgaaaggccaggcagggctctaagtatttctttttgtttgtttgtttgtttattatactttaagttctgggatacatgtgcagaatgtggaggtttgtcacataggtatacacgcgccatggtgatttgctgcacccatcaacccgtcatctacattaggtatttctcctaatgctctccctcctctagcttcccaccctgctgacagtacccagtgtgtgatgttcccctccctatgcccatgtattctcattgttcaattcccacttatgaatgagaatatgcggtgtttggttttctgttcttgtgttagtttgctgagaatgatggtttccagcttcatccatgtccctgcaaaggacatgaacttattttttttatggctgcatagtattccatggtgtatatgtgccacattttgtttatccagtctatcattgatgggcattagggttgattccagggcatttgtgttggttccaagtcgttgctattgtgaacagtgctgcaataagcatatgtgtgcatgtgtctttatagtagagtgatttataatcctttgggtatatacccagtaatgggattgctgggtcaaatggtatttctggttctagatccttccatggctctaagtatttcttaatcctcacacaggcaggctttcttgctaacctctttagagatgaggaaagcagggtgcagaggttaagtaacacgctgaggacacaggcttcagagaggggtgaagctggcctttgaagctaggttgtccatctctagaagccacacccttaagcctctgctgcaggaggtgggagttaaacataggcaatgagaagtcattgaatattttggttttctgggtcctgagctgcactttagaaataccagtctggcagtgatgatcaagtgactaattcaaagggtattttgagagactgagtgaaaggaatgaagacctggaccagcatggtggctgtgggaaggggcaggagagacaccggtgcaagggagattcagcaggtggaatctggggcttgcactgattggatacaggagtacagttgcttaaagagggagaggtgagagaatgaggacgccattgttaggaaacaaaaatcaggagatgtagctggatttagggagaataatatgccttcagttttggatgagtcagttctggactgctctcattccaggagatgttggaaacagagactggatccctgaggagatgctgttagtgagcattgattaacaccatgggactctgaataggcagtagggtaactcagaggatgccaagagagaatagaaagatataataaaggaggatgagcacaagaccttggggaatataattacaaaggatggggaagaagaaaaacccaccacgctgcaggagagtgaactctcagagaggcagatagatgagcaatgagtctgctgacccactggtaaccaacagtaggaactttctgaggaagacacagttaatggcgccacccttgactcatatatcagagaagaggagatggagggagttgaagggaagaaacagtggaataggaaggcttggtagcaccttgccaactcagttcagatgaaaagcctgagagaaactgagagattatcatttggctggcagagcagagttctcagggtcctggaagctggctgtcttcaagcctattaatggttaatgtttctcatgctcttttttgctaaatttgacaaacctattccccttcctcctcaaagtcaactgagttattcactcagttaaatctatcatgacttaaaaagtatatgcttagcttggagagggggttacatctgttcttgtagtcacataattactggagacatgaaggaagattccagcaactcaggcgccttctgaacaggttgaatacctggtttttatgagcaacccgcttcagttttctgagaagctctgagtaactacaactaaacaagtctattcttgaatatgtttataataaaaaaggaaagataatgcagttatttgctaattgctgcaatgattaaagcaagatgtttcaagtttatcctttcataagaccagcagccttttgaacacaaacaggatctgacaaagatagtaataatgaaagcgggagaacaaggaaacaatgccagttttcttcagaacaatcggttgccactgacttctaacctacctacagtttcaagtttctttggctgggactatattctggtttttcagtgctgtactgtgattaagccaaacttcagcaaaaaaggaagtgctgcattgtagcagtattgaaagttatgtaggtggattttttaaaaaaaatattacagcctaaattttcttagcaaaagtcaaatgagtaacaacacacagtttggaaacatttggagaggagaaaacaaatatctgacaagagtacttaaaatctgaaaaaaaaaaaaaaaaaaaaaaaaaaagaaagtgggaggagagtgagaaaaagcccctgacaggtaatggtggaaacctgacaaatggaaggtcattctaatgagagaggcggcctggtctcatggaaagagactttggcctttggaatctgaccttcctggatgtgaattccaggtgtgcagactcctggcagcaatactcttgggaaaggtgcactaatgttctgagcttcaatttcttagtacattatggggcatatgggaaagagacagaggtgggctacttctctctccactccaggatgccaccctcccactgttccccaccttccttcttccccaggaccaggctgagctcaaggcttgtccctaaggcagctggtgaaggaaaggttcgacttggtggtagaagccctggactggagtccccacctatgggctgagggatcctccacaagtgattcaacttcttagtttctcacctacaaaaggcagggaaattcctgccacaggacaacaaggaagttaaatgacatgattttttgtgaaagtgttgtggaaagcacttctgtcttctatcttatgaatcagtagggaatgagcattctcaaaatgaccagaatgattcctaatttcctttctaaggacctgattcccttttcatacgttctttttgttctaaaaacaaaacaaaacaaaacttactttgtaaagaaagcctgaattccagagccagagtctgtccgttaaaaactttcaagctttttttttaaacttataaaaggcgttataccctatagccactcaaacttgtataaacaagagttgcaatgtgaaaaaactcacttgctgggtttgcctctatgaacaactattgttgtcaatgcaaattgaatccgaaattacccttgtcattgtttttttctggggttgcttctttcatttctgttaaaaatacacagaaacattaaaaaagtaactatctcctctgttttataaggagaagaagggataaagaaaaagaaaatcaacttggcatgcaagtgagccttgctctggaatttgggtgggtctaggaaaaagcaccgacctcagtggaaaacatatatgggtgtgtgggaaatccctgtaaactataaattgactacacagtgcttaagctggtgtggagagaaaccacaatactctctgaaaccagagaggaggggacagagagcaagttttgcacgaggagagcacaaagtgtccctgggagacagagctgctggtaattcttagcaggcttaactggatctattgaaagtgaccactgtaaaacaccactgttgcaccctggggttctctgtgggatgcccctacttgtatcatgcaggaaccctatggcctgactctgcttcacccacacttcttcccaccgctccccagcaaggccccccgccctgttcaattgctcctgtatgcttccccacttcactgccattgcctttgcagctccaattcctggaaagcattctttcccttttctattagaatctcattatgtagcttcgaagcccttcaaggcctgtcaagactcagctttcccttcccgatggggccttacctcttctacactttctaaatgttatcttctccaggctgaacaaaacctagtgtgtctctttgctactaaggactaatcagatgctgtgtcctgattcattcggtgttggtgtatcccatatctccaatcagattacgagcccctggagggctgacagcacgttggacttggctgagctagaatcagctcccttttgcaccctgagctgagtgcatgcagctcagcatttgtaatcctagcctaatgcaatgtgaaatttattatctctctttttacaaatgaggaaactgaagatcagggagacagtgtgacttgtccaaagtcactagcccagttgcctttcagaaggcatctcactccatcttcaggatgaccccaggggctaggctttcacactttaactcctcctagaaggtcataacctgaagatctgagatttgaacccaagtctgtctggctcctaccctgtacctttcccactatagcatattgcctccctatcaccaaaatgcccaacacgaagttgaacatggcataatatcaaatgaacttgtgatcatcccgttttgtcaaaactaagagaacataaaaaaaaatcagcaaatttgaccagagcagtgtatttatggcaagaccaaggcaaaacttgattctgcattctttgcattatagtaacagactgaaaaggttcataagtgtattcatatttaagggagtgtgtaactgttctacctgggtcaatgtagaattccctatacgttgcatgcatcatcaggaatttcatatgcagcagataggcatacagcctggtttctccaacagccaaaggcatttctgagtggcaacaacactgatctggtgaagctgagtccatctggacattggggagccccaggccagcagggtttctgctaagtggacctttccaaatcctctcagggacaaaacctggttgggcatcttcaagaaaagatgctcttgtaaagttggtgtagctgcttaaataagccccgaatagagtctagtccgtctctctgtgcttttctttaaatttcccttcatagaaagctaaaacttaaagaggtttcagagaagctagtctgaccccatctcccagtatcattgagaaaactgaagctcggaggggctgggtcatttgccggaggttttgcaggacacagaagagcttgttctcctaatgtggcctagaactcttcaccaggcctcctcctatcccaggtggaaactaaagaggaaaagatgaagccaaactcaggcggaagcaacataattaaactggtttatcgtttggcaacagagatcagaggagtgagtggaaagtgaaaatcagtgaaacacttgcagtttaaaagaggcatgcgattcctgcttttcctaagcagttgaaatgtgtttatatgtctttcctggagctctctcattgctaatgtggtcctataaggggaagtcctggagactgagctgggtgtatttgagtattcttctcaatggaaggcaatgagcttgtgtgctacactgcttaggccacacgatcccccaagcctgggctgccagacgtcgccatcattgttccatgcagatcatgcccatcctgtgcagaaggtcactataggaacacatggcacagggaagaaaacgcccatagaaattcacatggtgcttgtctaaaccgaaggcaggtgagatccacccactgtcatgggaagctgctagcatgctcccatttgtttataataatttctccaccgttagaggctgctttaaaaagaaacggccaaaacctgcgatccggtgccacaattgagacagaaagcatgggaccatgacagttttaagaattactaaagtatgaggcttgaccagatcatttttccaaggatccagagccctttagagagaattcaagagggagaatttctggtgacttctaccacctctgaagaattaaaaaacttacttgtgctgctttccaggcctctgtggtagttaattctgcttggcagtttttgttgtcaaatagcttttaagaaatctggagctatctcagatataaataccttaatgatgccagaggactgtctttcacccataaaaactgaagccatgtgccagaagccctcgtggctcaagggctctgtccttggacacggatgagggcagctgggcggtgggaccgaggctctgcctgaatgctcagcttctgcaagctggggtggagagtgtgttcctgcctaccggctcagccagcacaggagcacgtagcctgcaggtgtgggttgtacacaggcttccccctgctgagtcagttccccagatctcttcatcacttccccagatctctgggatcttcagctgagattgggccccagcacctggactcaaggtaaggccccttaggatgcttgtagctgatcaatcagggtagtgcaaaggaagaggggaaaaagccacccagaccttaaaggagatttctggaagatccaatcaaagtgattcaccttaacctcaggcatgacttttccccattatctgctgtttttaatttcaagtagtataaatcttactgatctgaagaagacttctgcttctgaaactaccagcgcttaacaatgattgagccctactctatgagattgcaaataaaaatatattaaccttggcaggaaatcaactgattaatacttataccctacactctaaagactggaacctcaatttatctgcataaacagaggctttgggtataaaagtaaaatgtagttggttatgccaaagactgctttcaatagtaatgcaccaaacatgcttttgaaaatagcaataaactattcatttaggttagatatacaaataagtaactttcagagttagcactaagttttaagcctcaaagactttgatttcagtgacaagatgtgtaaatgcagcggttagaaaaagtacacatactgaggtttctttcaagattatatatagtattattcaaaagtcttattgtatatgaaaagtgacaagatttttgcaatatgaaacaacagtagctagctaatactctagttacctttacagattgtctagttggtcacattataccttaatttttcaggatccaaccaaggcctggttaactcttactggcaatgtttgaaagggatgaaagaggtcctatgcatattactctaaattaatcttagtgcaggaagacaagtcatatttgaataactttattttgtatccctagctactgtcatcctagtatttgaaaagctccttttctcccaatgttcagaaagtcattttccaaacttgcaaatattaaaacctattcatgtctaatacttttctacttggtctatttccatgtcctgtcaatgacctatcaattaccctattcaattacccatgtcacttgagatttctcccaccagaatttaggttgcatattttcacagggcaatttattttaaaatcagaatggtccataaaactaatagctttgtgtgcacagacctaaaagatttgtagtagctctgcagctgcatttttgaacatcaatagttaaacgatcaacataaatgttaaagaagtaaattaactttcagaatttcacgtgtgctctagcattcaccattgaccatgctggaagaagactttgaggtcatttcatccaaccctctcattttacagatgaggaaaacaggactaattgatagctagcaatactaaattatagctcttctaaaactagacagcagcgtcagtaggcttcttcatgtgctcaattactgtatggattccacgagttgatgagcgtgctgtgaccttgagcatttacattctgtggttttcaaatgtttatgtttctaatgtggtatttgtaaacctgggccccagtaacctttaccactgaggctttgccaatcccaactctgggcagcccacctcttccatatgcagcagtgcttgcaggctgttccgcctgggcaaagtcatgttaggtgtaagcaaagacgtgaactagtgttcatgcttgaaaacctcacagagacctgcctgctggctgaatcctttcttcatctcttgttgcctctcctacatgtgactcaaaagctagccaagtttgttccacatccttcagcttgttcctcttacaccaaagtgccataccatcatcccctttagtaagatcacacttctccaatttctgtcctcctctactcctcaataaacaggaagatgctgtctgtggaaaatgcacgtggagctcttgcacacgttttctataacttgtcttccttccacttccccacaactagaatataagcctcatgagagcaaatgccttgtctggactgttatctcccctgtgtctagtatagtcaaaaatagtaggtgatgggtaaatacatgtgcaataaatatatcctttcatctttccttcctatcttagggaaacaaatgtccctttcttttctgtcttacctccctaataacatcagtacttctttgtccctcctccaatattgacctctgaatcacgtcctccttcttgaaatcttgccttcttaattgtctgcttttattaatttacataggtgtccagccatctggctggcctttctccagttcttttgctggaaaatcctctcctcttctctttaatacaggcagcctctaagattgccccttcagttgctttcttcccttggtatttttcttttttttgcagttctcattgactcatatctggtcaacttttacctctaggtacaatgattcttcaatttccacctccagccccaaatttaattcctagatatggacatgcttggagccaacaccaccatgtcacctcaatacactctgcttttcatccaaatcttcctttccatccaggcagcaaactccagagtcctttccactcctgttcaacctttctacttcacatatgacaggtgtgtgaattttacctggtggcaaaccaacgtggtgattctcttgaattcatgtattacttagacaaattcaacagcctcctaaatgatctccttctagctgctctcctccctctccatctgtcttgctagatgagcctggcttcttttttcctgcagaaagatcaaacttttcagtttaacccgcatcaccttttaaaattcattgccagtgtagttcccaatatggcctcatactaacttcagataccccagtgtatctgaagaaagtaatcccagctacttgggaggctgaggcatgagaattgcttgaaccggggaggcagaggttgcagtgagccaagatcactccactgcactccagcctgggcgacagaccgaaactccgtcaaaaaaaaaaaaaaaaaaaaaagcaaaaagcaaatgggaaacttttttttgaaaagatcagaggctccctttttaaaagagcagagctcaggctcttactcacatccctgtgccccaccaaaatattctgattttattgtcctgtgtcagagccaaggcattagttcattttaaaatccccctaggtgaatctcataggcagccatggttgaaagtcgctgataattgataaaccctatggcccaatcaattgggagtacttgaaacatactttgccaccccatagttttgcctgggcaattccccttgtctgtaatcttctttctcctatttttttttcctacagaaaacacatgataacttctttgatttttccagttagaaggaatcagtcctcctcctggaaatccttaataccttttaatatatcatattcattcatgtgatctaggcagaccttgtgttagatatggacaaaatggagagaaataagacaaggtccttgtctttaagcagcttacagtcttgccagctcactggttacacatgaactagtgagtatcaacttttatgatagaagtgtccatgggatactgttaaggcatgaaggagcctattctgcttggcatgataacaatttatgtatatgtcatctcttatatcaaatggtatactttcgagggctaagatcatgcatctctcacctttacgtatttcaaagaccacagtagtataaaatgtttgctgaataaatgagcaaatgaatgatgttttggtaattaggagtcactggggaataatggcagctcttaggaaatggtaccatagttccattcttggggtagggctgggcgtgtccccatggagttcacagaactatgtcataatttcagtactaaattatgtgtgttttacagtttctctcaatcacccattctatgttttatttaaaatggtaataggaatagcatgttagaaactgggtcctgtactcattaacaaaaagaagggagcaacagacattggggtctacttgagggtggagggtgagaggaaggagaagcagaaaagagaactattgggcactgggcttaatacctgggtgttgaaataacctttacaactaacccccatgacacaagtttatcaatgtgacaaaccttcataccctttttttggtaccccgaacctaaaataaaagtttaaaaaattatattttagaatatattcaaaaagtaggatattatttctcaaagaaaacatctgaattcatactttaaaaatattttttaaaacttgaagtttgatcaaggcatttacatcctaggagacaaaagcaatcatttcagtatgcattctagatttatcaactgcatacatattttaggaagattttaagatatttcaatataatatctaaaaatgaccacttaattttagtaaaaagagactcccaccttctggtaattgacaattactatggtctgagagtgtttagattaaaaaattgtgtgtgtgtgtgtgtgtgtaaaattatcacaggaaaatcaatacatcaatagtagcaccaaaaaagaaaaaaaaaaggaaagaaactaggtcctatttttcatgactaagaagttgacaatggtctttccaaattaagactcggcatctttgatttttgtaaacatatcctggagatcgaatgtgaacatttgatggctgatgggaagaattgaggaggattaggggagcacttgactttgccatgattctcaagttaaatccttggacctcttaaagatgttgttgatgaagctgctaaaatggtcaccagatgaatataaacaagtaggacccgcagtaatttccaggctaattttgtgcacgtgcgtttaggggcgagtcaaattaaatgaatgaggagctgatgttcatgtgaaagtaattactctcctccagtagaaatcctaatcctacaagtaactgcagaaataattaatcataactaagaagcaaaccactctcagggagaaaagctgtatctgaacttccacgtgctcttggaggatacgggtgattcacggcataagagtcatctaccaagtcatctgcaagagcgagtgcagcttccaagagggtctgagtcagaacagataaaaggaagttcttcttaactcagaagatttcaacactggggaagctcatttcccacagagatagaaaaatgtgcactataaatcactctcaaaaagcaatttagacaactacacaggtaatgataaatgcatggagagcactcacatgttttgggttgtgtttttgaccttcattcattctttatagattattaatccacggattaagtcattgactcatttatagtcatgagtcattaaaacttttctggagcatctaccacatgccagcaactgtgctacttagggtacaaaggtggacatggcccaacccctgccctcaaagaacttctagggaacactgactttgcaggcatgattccgtctgcatcacgcatcagtaaacagctatgtgtactgtagggtattgagacacaatgacgttccctctgctcagctcatcaccacaaccaatgtgtaggagcttgctttttgagacccagcggtgctttctataactggaagattccaagtttcctttgcttccatttatgcattcagcagacattaaggccctgctagaacctaggcattggcatgtacaagatgagatatggcagcttgcattccagtggaaggtggtggggtgtgatggatgaagagctggcttttgagtcagactacaatcttaaacattgtcgccactactagctagttgtgtgaccctaggcaaatgctttaacttatctagcctccatttacttatttttaccagcattactctgaagtgtggagttatacatacatgagctgccgacacagtactagttacatattcattctcaactagtggcagttgttggttggatcattattataattaaatatacacaagcaaaacagatatctctagtacactgagataaatattctgggagacagaagcataggcaatcatgtagagaaagccccaaacccatgggaacaggtggagaaagcacctacctagaaagggtaacaccccaaaggatagacatgagaacgctggccaagacaggaggtgggctttcgggcagatggcatggcatcaagtcaatcaatagaggactaatccatctgggcaactgcaagtcattctgcatgacctgaccaggtaacaacctaaggagtggctggcactaaggcaggtggggccagtttctgaagggtcagtttcaggagctgaggctttggtttgtagacaatggggccactaagctgggcggcagagtgctttagggacaccactgaggagggactatgaaggatgctatagagagaggacaacttgagatggggacctcaattatgagcctgtgctgtcatgcaagaaataaagtatgtggatctaaaccaaggcagtgtcacccaagaaagaaaatgtgtggatctaaaccaacgcagtgacagtgggaagggagaaaatggacagcttcaagggatgttggggtagactcggggtgctgagtatttttcagtgcctgagggtctacgggaggaagggagttgccctgggtaatggataatgaagctaggctgggtctaatttggggtgtttgtgggcaatcaaagggaggaaccacacacagttgactgttgttctggcagtcttgcaagagcaatctggaacacaaaaagtctaggcttcatgaactacaaaggtaacatctgaaaccatgggagtagatgcaggagtgtgtctttagtgaaaataaaatagttggagcatggagccttggagaaaatgccacttcaagattggcagaagaggaagaacctacagatggaactgagaaggcatcagaaaagtagaggtcaagttgagagaagagagtagcagcagactgaaatgctatggaaatatcaaggaagataaggaatgaaatgtatttgccagctgagttgtaagtaactctgaccaagtggagtggtgagctgagaggttactctcttggttgaagagtaatcacccagccctcaaggaagtggaagcaaagtatcgcttctgtcctttttaaagctcttctccatatcattgactctgctccccaaagcttggcttttagtgaaagccattctatttagacaaactcattgtctctcctctcaaccccaagacaagcattttgatctctttaactccatgggttttattaccaatgaatgaaataggacatggcacacagagcagacagaaggccattgccaaggtctttcaactggggtcccactctcaattttacttcctgaaagttcaatgtcttggctgaaaacagggctgaagatagatccaaggaagaccactgggaattggccaactaggtttaaactggggaacaactcccctcaagtggcaattttaagggtcttcatcctgcctcattggctttaatccctcttgaacatgtcaaagtggttggaagactgagtcctggtgggccacattgtgtttctgtggactgcggactagtttcagaggaagcacctgtctaacttaaccagggatcacttaggatgaacaccagttacacagtatagaagacataaatatttgaaattttatttgcagccactgttgcacagtgcaagctgtctcagaaattaaggcatatatatagttcaaatgggaccaaagtagtcttttggaagtcataatagggcacacatacatgaattgttgagcagaccttgtaaattaagagattcattgtattcaggcaatagtgtgtgggtgtgtgttcgctttctttgggaaaacagcatttgtaagccactcactcccaacatcaggggcacgtcagggtgagggtatatagaggtagctgttattagtgagaatataagcgacgcctgacttagcactctgttactgttagcactaccgaatctttgatgactaggtgtggtcaaaatcttggtttccagctatgtttcccataaatgaagtttccagatataagccaaatgcttaaacaaaattgctgactacaggatcattttgtaatactgtatgggtgatttataagctgtgtttttttaaagaatgaagtcatctagtggctttgaactttctccccataggtgaagttataagtccagcaagctcctcagtggctcctttctcaacagtcatgtgagagaagccagcctcaattaagccccacggcattcactgatggaataaattaccttctattgtatatgtctagagtgatgcttgctataaccatccatggaagaaatgagaacacagtcactcaaaccattttctgggttcagtaccgtgttgtccagatgaggaacagtggctgcaaaaggccgtttgctatgcagagtgtgagctttcacctccagcctcagcctcgcctgggagctggttagaaatgcaaattctcagacctactgcagaccttttgaataataatttgcatttaaatgagccctcagggaattcgtatgcaagtttaatcagtattggtgtgaagcaatggattcaaaaattatagcctctcgcagcacacacaaggatacttagggacatacatgcacaatatatacatttttcgtcttgctctaacaaattacatatattttatttatttttttcaacttttattataggtatggggtacatgtgcaggtttattaaacaagaatattgcatgatgccgaggtttggtgtataaatcctgtcgtgcaggtagtgagcacagtacctgacaggtagtttttaaaaccaccccacagccctctagtagtctgcagtgtctattgttcccatatttatctccatgtgtgctcagtgtttagctccttctattataagtgagaacatatggtatttggttttctgttcctgcattaatttgcttaggataatggtctccagctccatccatgttgctgcaaagaacatgatttaattcttttttatggctgcatagtattctgcggtatatttgtacaaaattttctttatccattctacatttatgggcacctggcttgatgccatgtatttgctctagtgaatagtgcagaggtgaacatacaaatgcatgtgtcttttggtagaatgatatagtttcctttgggaatacacccagtaatgggattgctgggtcaaatgacagctctgttttaagttcttttagaaatctccagactgctttccacagtggctggactaatttacatttccatcaatagtgtagaaactttccctttctttgcagccttggccagcaactattttttgactttttagtaatagccattctgactggtgtgagatgataactcttcgtggttttgatatgcatttctctagtgattagtgatgctgagcattttttcaagtttgttgactgtttgtatatcttcttttgagaagtgtcggttcatttcctttgcccattttttttaaatggagcaatatgttttttgcttgttgatttattcaagttcaccatggattcattttaaaatatgtataagatataaacacttaaaaggataaagtggaagctacaattgaatacttctatcattttgtcactgtccctgcttgggttactggtgtaccccacattggagacatctggtgtaaagaagcaaacagagccgaaaggaatcttagaactctttgtctatgatggtcagtgtactggggaacatgaaatacacagaggaagtaatttgttggatgaaattgaatatacttatgtttgcccatagtttttatcggttttgtcattttgagagatgtacaactaattttctcttcaagatagaacattgtggcatattctttgtgctacgaatcagaataggaagacgaaatctttatttctaattgaattgttcaaatcagtgaaatattcttcacccgaacaatgtgcctagctgtggactggattcctctctgggattcctctctgacctagaacgttgggcatcataaccttaggcaagtgacattcttactaaatcggacgctgagtccccttgaatggcatctctgcccaccgtgtgcctcccttaaacattaagttcctaccacatgccaggccttgtgtttgccactcaggatgaactactgtgcccagtctatggggaaagctaaactccaagactgatcattacagcagcacagtaagtattatcatgaggtgtggacaatgagaaggcagaagagaggaacaaggtgaacgctacctgcatgctggaggagatgacatttgagcggggcctcgagggatgcgtaggagtttaccaggcatagagcaaagaagaaatatggaataaaggggtcagcctaagcaaaggtatagggcaggatatctgctttatcagcagtatctctgggtgaagtgcaaactcttctaattcagtcaatgaaatgaagccttaagatgactgaaaactaggttcttggatttgtgcaatagatatttggaaatatctctgagagtaaatgatttcataatgtttggccacaacactgtgtggaaagtttctttgtgtaatataatacagaaagtacttctcatttacagtaaaatctggaatacttggaaatggtctgtgctagggaaactgaattttcagattaactgcataaaaatggaaaatctggttgaaaaaccttcctaattttgttttcctttagagagataactgctgttaatattttagaggtgttttattttgatcttacctagagagagaaacagagagattaccctgcatatttagctgtatcaattgccttttaaaaaacatatttagcattttttcatgatttttaaacactgcataatatttcagcctatgagtgttttataaatttaaaaccattcctatattgttggtgactcagattgcttctaatgttttaatatcataataaatatagagaacactcttgtacattatcctatcatacatttcctattaagtcttaaaagtagacttactgactcaagcagtctaacataaatagtttaaaactttgagtatacattgtcaaattactgcctccctcaaaaaagttatgctagattactctatcggacaccatgcaggaagctcttcatttctgcaaactcgtcaatgtagaatgttcacatgtcttttaaaattttcggtaatttgataagtgaaaagtgaattcctggtgcctttgtgtttcttggactgatggtccctcctcagtctcctttgcctgtatctctgactctgcctggtcttaaggctactcaggctcagtctgggttgctgcttccacactactgtctaagggggaagctcctgcactttcatggctcaaattccactcgttggcttatgtgctaaaggcatccctcctgtccaggtgtctctgttgaaggccaggcccatctgcacagaccctagtgcttacttctctttaggtgtctccaggcagcctccagtgcacaccttcaaacctgcaccccagaggtgagatcctccttctgcatcgggattctgcacaagcgtgagctccatgctggtataacacccaaacattcaatctgggtgtcccataacatgtgcataatgttaaaattacagaggaagatccagtgtcctctgaatcagtaagatagcctccgcccaccccaacacacctcatttccatgccaggaagcctggagtcatcggtgagacttcctcttctctctgccttgtcttcttaacatccacctgttggagacgcctgttgactctgtctgggacctgtcactcagagctcctggctagtagctctcaagctacaaacaccgcccttgtccatgcatcagtaatttcaactcagattactgaaagtgccgattaaacagactctcagcatctatgtttgactctttccaatacattccctatgctgcgtttaacatgatcactttcaaaagcaagtttgatcctttctcttccttgaataaaaccccaagatactccttgtgctccaaggatgggggtgacggtcctcaaggagcccacaaagccacatgcaggggcatggcatggctctgcccttgctcctacctgacactgcttccctctcgcctactcaatatcctcctcgtttcctggaaggtgccaagctccatgctccaactccagactaggacatgttatataccccatgtgctagtctctcatctatccttgactttctccccagttcttcccacaaatgtctttaaatcactcatctaatgatgtatttaatgcctcttttccctgttttcttgcaaactacccaagagcaaaaaccaagtcactcttaatgcttcatcagcagcatcctgtgccatgcttagcacatagttggtgctcaataaattcttgccacacaaaccaataaataaatgttaaagtgttgaaatgtcttttcaccttttcaacattttttgaattgcgtttctacacacgttgcccacttacgagaatgaaggctcttgttgatttgtgaaaactttatatgaaccctctgctgttcatccgtggtaaatgtgattccttttgataagtcgtattttatgttttatttgtcgtatgcatatgacaataacagttaacacttgtgtaatgattaatactaatcattatactaatcatacgagcaggcagagttttatggtgctttatatgtttttatttcacgtgaccctatgaggcatagaaatgatcatcatcgccattctgcatatgaggaaaccgagtctcaaaggggttaagaaagttgtccaaagtcacacagctggtgttaacagaagcagggtcctgtgctcttaatctttacgctatactgcctctgaagaattgtttaattttttttaagtacagaagagataatgttcaacctgacttttgaaggacaggtgggagttaaccaagaaagggagaaaatgaagaaccttcaggaaggaattcatgtgccagatgtgggctgagagggcacccagctgctcaggaaggggcaagtatatacccaggctctgttctgaggtgaataaagccagagagggagcgagagccagggcttaagggtctttttggttttccaagttgttcaggatttgtcttgtcagcagtgggagataccggaggatttatgaaagggagtattgtctcaattagtactctagatgagtaagctttgtctttcctggtaagaattatcttgaaaccatggcaatataaagttgcatgtgactgagtggtatattaactgtaaaaatccaccttcctggctgggcgcggtggttcatgcctgtaatcccagcactttgggaggccgaggcgggcggatcacgaggtcaggagattgagaccatcctggctaacacggtgaaacctcgtctctactaaaaatacaaaatattagctgggcgtggtggcgggtgcctgtagtcccagctacttgggaggctgaggcagaagaatggcatgaacctgggaggcggagcttgtagtgagctgagatcatgccactgcactccagcccaggtgacagagcgagactccgtctcaaacaaaaaaacaaaaacaaaaacaaacaaacaaacaaaaatccaccttcctacttccgagaagtgctacagtaaggctatgaagaccaagcattatgtatgtatctgagctgttttctgttatttccccctctgtttttatgtcagaagaaactgtaccattacttctagagtagaagatgttggaatgtctcctcattggtcttactgttccaatcacgtgagcaccaatgtaatgttcattactaacattagtgcctgcaagaatatcctactggaaagggaattagctgtgattttgttaagtgtccagccaattttcataaaagacacagtatctgagatggctgttaaacatgtcaagagattgtgtacgaggggaataaatcaaggaagactctataggttggtctgattctgtgatattaccagaattactggtaatatctacagcatttagaaacttcatccacagtcagatttaatcccagggctatgaagcctggagaatatatgggtagaactcaggagaatccacgatctcacatgaggagaaaagaacagcagtttattttagatggcctctaactaaaatttgtattgagtgtgtgcagcaaaccacagatgtactagctgcaactgtgactttgtcatagtggaaatcacagacatttcaatatcacattccagtcatttcagagaccttgaaataacattgctgctcaccacaccttcaaaacattagctctgatttaatgcttggaaaagtataattttgttttttcagtactgtaataggtgcattttaatatcattggtgtcttctgtaatctttgtgactttacttttatctgtttaaacactttattctgagaaggcaggcatgtgtctcactagtccaccaaaaaagaccataacataaaatgttaagagcccctgagctaatatcttaaaaatgagacaaacttcttagcttttctgacacctctggtaagccatgcatgaaaaggctgcacccccatcccgcagtggttagatttgttttcagagtttttagtactgggaaaatctggattgttttttttcttctaagaaggatggctttacgttaaaccctgtctttaagtttcttggccttaggaatgactcttgagcataagtttgcttttccctagggatgccagatttagcagatttagcaaatacaaatgtaaggccactctgtactatgcaaatctatagatacatatatgtaaatagtacatatgtatctctgaatttcaaataaacaatgaataattttagtataagcatatagcaaatatagcatgtgacaggcttatactaaattatttgctgtccatctgaaattcaaattcaactgggcatcttgtattttatctggcaactctaaaaacaccaaatttgggccaatagtcctccggctaattaactacagatggttagaatgtgttttcttacactgtacagtgatggaaattagttaactgccaaatgtcttaatttttgattgaatgtgaagatatttttaagtttgaaattttgtattatcattcagtgatcacagagtctgctttcaactttgggacaagcaaacaactgagaaatactaccagtctttaaagcaaattttggtataaactgtgttccactgcgatacagtttctatatcagagaaatgtggtcaaaatgtagactgatagtgagacagaatttcaaaactttttgacatttgtcccattgttaaataacttgtttttttctttgttttttttttttttttttttttttttttgagatggagtctcactctgttgcccaggctggagtgcagtggtgctatctcagctcactgcaagctccacttcccgggttcacgccattctcctgcctcagcctcccgagcagctgggactacaggcacctgccaccacgcccggctaattttctgtattttttagtagagacagggtttcaccgtgttagccaggatggtctcgatctcctgaccttgtgatccgcctgcctcggcgtcccaaagtgctgggattacaggcatgagccaccgcgcccagccataatttggttttaaatcaagcacaagtcgtaatttccattgcctgggatgagattcatgctaataactaatatgaatgccaatgaagataagaattttacctttgcatgcaggtgaattacatcagagcccattagtcatcaatttgtagagactgacaactccacatttatttcaaataaaagaaaatgtagtagtcagcatgaggccagaaaacaagccagcctgaaattgttacccatatttataaaacatactttctatgtttccgtgccttcatcgtagtgcaaaatattataaatgtgaggcaaagaaagataaatgtgagtggtaaaaattggcagactcaacatcttagtgagagagatagatttacttaagggaaagtcagtttggaagtattgtaaattatataatgatatggcataaaaaggcatgatccagtctcaagcatcttcttatgtctcacagaaacaggagttaagaaaaccagcatcactgcttacttcccacgtgtcatctcctgtgaatgctccaaccatgtccactttgaagtttcattaaataaaacacattaagccgggcgcggtggctcacgcctgtaatctcatcactttgggaggcggaggcaggcagatcacttgaggtcaggagttcgagagcctggccaacatggttaaaccccatctctattaaaaatacataaattagccgggtatggtggtgcatgcctataatcccagctcctcgggaggttgaggcacgagaatcatttgaacccaggaggctgaggttgcagtgagctgagatcgcaccattgcactctccagcctcggcaacagagcaagactgtctcaaaaaaaaaaaaaaaaaaaaaaggtcaaatacttgcttctctaccagtattatctgcaaaaacagaagccttccactctgatttataccacagtcagacaaacccaaacgctgtggatttccttctccttaaccaaatggtactgttttgagccatcttctcctctgttgtaggtttggactaatccagacaaaaatagtgagtgagattccactagcctgttgaagaaatctctttcctaaggagaaaattgggaccaggagcagtggctcacacctgtaatcccagcactttgggaggtcgaggcaggtggatcacttgaggtcaggagttcaagaccagcctggccaacatggtgaaaccccatctctactaaaaatacaaaaattagctgggtgtggtggtgcacacctgtaatcccagctacttaggaagctaaggaaggagaatcgcttgaatctgggaggcaggggttgcagggagctgagattgtgccactccactccagcctgggcgacagagacagactccatctcaaaaaagaaaaaaagaaaattgagcagtgcattacggaggctgacacagtacaattcgcctcctcaccccctccacactcacttccagacatcagtgttcctgttttgccagtcatctcacaacaatgcatgtccaagccacgctgtgattagagggagaatatgcttattacccaagttcttcgcatgttggagcagggagaggccaagggtggtaaaccacaggaaatttccatttgccctccgctgcggcactctcactctatagggaagttagttgttattaggtaataatgttcagcggaggttggtcactcgtaacaacagacagatgtgtaatgttttatttgggttagccagctctctcacaaataaagggcctgaaattaaactgtctttatgaaaatattcagtaaatgatacctctggcttattccagtgctcagattctttgccatggaaaatggcaaatgagtcccctgttgggcccggaatctgtttaaacttgtctttgtcgagtacagaagggttgatgttctatgagattaaaaaaaagtttttaaagaattcgcatcgaggagtaaagggaacaacgatgcaaaccacatttagagatggaaaagaattttttttagtacttatggaatttcaaacaataataatggaacagaaacataggaaaaaagctacatatctgaccacagaggcaaattgcattattacatgctcacatgcaatgcaaatgtggattggtctgtaaaggaacactttttgcttttctaatgtatagtagggtgagaggagcacctctccaatttgccaaggcatcactagcaaactccagctaccgaattgcttggggaaattgagttcttttgaagacaggttcttgggaactgtaccccaagaacttctggttaagtagctcaggtgtggagcctgagagcctgcatttctgacgatggagatgctgcggttggatgaggggagaagggtcacactattctataccaccctgtttccagtagccagtgagatggataactcatctcaacatagagtgtgaccacgaagagagatacctacccgtaaaatggactaagattcacaaaagcttgtttccagctctaaccttgttactggctcagtaaccttgaacaagttactcaaactttttgatccttttatctccctagatataaagtgtagagtttagaccagatcagcactcctcagtgttctcaaatgtcataaaaaggctaaacacacacacacacacacacacacacacacgtatatatagctacagttaagcaggttttataactgtaggacgtctcagaaactgtaataaacaaatgtgcaatgtggctctccaaagagtgaaaacaatggggtgtctgggggctcagcttcagctccagtaggcaaatccttccaaaagtatttaaccacaaattcctttatgtgtatggaacacctgaatcacacacttcagcaagagaacccctaatgtcctccagccttaactttcccatcctagaatctaggttctccccacagtcctccaatgttcccagccaggccaatgctaaaagcttcccttaatgatacccattatccaaggaagaaacctgagagcaattttctactacctgtttgcttttttccagcaattctcaactttttgccaagacattacacccgaatttctatccccaaggaaacattttctaactaaaaactccacctggccactgcagtacttatatatttaatcccaatgactttctccattcctttgtttgaaagtaatgagactaaattttagacaatctaatttcttggcttattcattttctccatattccagataacttttaagtggtgaagagtataaatcgtggttttccaagtgtagtctaaggtctaacagcatcggggatatctgggaaattatcagaactacagaccctctggctgcaccccaaacctgctgaatcggaaattctgaggtaggacccagtcatttgcatttttatcaacccctccaggtgattctaaagcacactgaagttagagacacagtgttgagatcagaagcatggactatggattccaacataccttgtgctatatcacagttcctttgtctgaaatatgggaataatattagtacttacttcagagtctatgtgagaattaaattaatatataatacctaatatcaggcctggcacagggtgagcaatgagtcaattaattacagctgcttaatctataatggatgctgacgcgtagtgagcaggaacttagctttgtcacactgcaccacgagactcctttgcaagctaatgctgatgatggtggttagataggagtgcagccgtgggagcagacagagctggtttgctcaccaggtgctccatgtattagctttgtgaatgcatgtaaattatttaatttctctaagcttagtttcgtcacctagaaaatagagaaaataatttctccccaaggtaaagagagggattcaataagataatatctataactgctttgaaaagtgcctggacccttttaagttgtcccttcccaaatgaaagctatcaatgacctaatgacagtggtacctgggcggcccagtgtgtctatgtgattacagatcctgaggccactaggtccttaaacttgggcttcttgctccacaaaatattagaatgataggatatgatacccttacaactttccctaaaaagctatcttgtcatgataaatgtaaatattgactcagaagtaatcaaaagataattagtcaccttttctatgttgttcttagggataaggcaagccattcttgccattacaatcttgttgaatttgggttctttttgtattcagtgttgagtcatagaccaacattcagagtttacattaagactatttcacaactcagttgggtgcagtggctctcaactgtaatcccggcactttgggaggctgaggtgagcagatcacctgaggtcaggagttccagaccaagctggccaacatggtgaaaccccatctctactaaaaatacaaaaattagccaggcgtaatggcgggtgcctgtaatcccagctgcttggaaggctgaggcaggagagtcgcttgaacccaggaggcagagattgcagtgagccaagattgtgccactgcactccagcctgcgtgacagagtgagatgctgtctcaaaaaaaaaaaaaaaaaggaatatttcagaactttatatctttcctttaaatgcagtaccttttaggtcaggcatataatcctaagataaaaaaatatgtattaatcgtgaaaatgtctctgtggtcaggtttcactaggttttgccttgttaacaactctaagaactgtgtggcttacagcaacaagaattttttctcacctgtgtttcaagtcagctgtagttgaattatggctcagttccaagtttccttcttcccacttaccagaaggaaggaacagcccaatccatgacccacccacatgcaaggcaagccatgtgatgatcccgacacctctcttcaggcatggtgtgggttactgctgttcacactccattggccaaagcaggtgacagggccacacctgacacaagggagtaggaaacacacaccccacccccgctacgcccgggcagggaaagtcccagtgaaggatcctttgtggaaggacccagccgagaggcacagcaaatagttgggagcaacatacatcaaccacaacctcccaaattgtcacagctctaccaatagtttccaagttcaaacacatcttccaaacacaggtcactgagaggaaactagcttccaagtgtgctgtaatctcaactggtgcttcccctgaaatcctgataattcccctggaggagaatgagtgattcttcagcctccaaggagctgtcattctttctgggccatccttcagtcctcagtagtctaaggaaaaagtgcttttgcagaaggaaagtagaatttcctcaggagatacaaaccgaaggattgccctctggaatctgctgagaatccactttgtccaccttgcttgttttcaatgaacatgtctgtttctgaggccacttggcaaagctatctgtgcccttggctggtatggatgagttaaaagctggactttgtacagtcagaccagcctttaaagcggatccttcactgctgcgtagtgtagggaggaaaatggcccaaggccaaggccaaaggtcatggtgcatgtgctcctgtgaccacagtcgagggagcccagggaggagagctaagcctttattctcaattgttttaagcctcctgagctcagtgaaccccaagtagattcttgtcaagcattttttttctacttaatatttaaaacggtgatacttaaagtcaaatttaatccaggcattttttatttctggacaaagagatcattgaaaaattaatttgtcagaaatatatgacacgcaaaaaagcaaaaagctttttaagtaacttttcttacaaacaggaagctatgttttttcagagcttaaaagtgagatccaccacaagttaattttagtctagaaatccaaagttactatttgatttagatttcactctttatgcctcatcaccctggttaaaagacgtggaatgagctcgctgaaggcctagttgaggaaccccggttctggggagccactgtctccccatttttctgtaagtgagaaatgttttttctaaggggcctttgctttgttagttcactgtgaaacgcagaatgaagttttctcgagatgggcaaattgaaaatcttcaaaatctggcctaacagagctctaagttttaaagacatcaatgtctttaaacattgccatcatcaacatggcaatgggtactacccttccatttcccattatccttgctgtgtccccaacactggaagtgtagttctccatatagctaagtacctttttcaatgtgccttctgttccattctgtttcagagtgtgtttattttctttcctttaacttcagaaaactaatgctcacagcataagcactcagtgacctcagaccattaatcttttactggtttgaagtaggagaaagtaatactgacctatccattcaatagttgtaagaacttcacttaggtagatatcgccattctaaaaattgcaaccccaacccacaaactgaaacgatataacaaaaactgcagaaataaacattatttccagaaattaaagaaaactgttaatggtttatatgaaatattgcttagctgggaggattaacccttttctcatttgccctgagaatactcactggcagcacttgaggctgcaatatttacctggagatgattttgccacacagtatattacttttattattattttcatatcactctagtatatcaactttggaaacaaaagacaacattctatttagagcattctgcttttagtagtggtatttttatttacaaaatatagtaattcttgatcgctgaaaatgtcaaatcctggaaaacacagcattcctacacatggtgttaacattggtctccaacagttgttggccagagattcatttgatgaatccaatttttccgaaatagacaattctgatgattcagatgattctgatgttagttctgtttagaaataactccaagaacaatttttatgttttactttcacattgaaaatcaatcagatttgcttcagcctcgaaaagcatgtttatgtaaaattaagtgagtactggtggcaagctgcacttttttttttaatgggaaaaaggttaagataggggaaattagaagaaactattcttctctcattctttgtgtttttatcttttggaaaactgttattgttgcttaccatgttagaagttaagccaggtctattgaagaatcactaagggaatataacctaaggcagtaacataaaattatatgaaataagagtatgtatcaacactgattcaaacttcatgaaagaagtctgctgaggaataaaattctataaattaagagcctatgatgaagtgcaattcataaagcctatgggtaagattgatgggcacaaagaagattctgggtcttaatagagcaatgacaaagaggtcatttgccaaacatgctgtggccacactggcaggatccagcctgtaagaggatgcacaggttaattgggaatactttaactataagagagtaataactgtaaataattggcagatcagaagaaacgtaggaagtataagtgtgcctgtgtgtgtgtgagagacataaaaatatatggatgtagacagatggatgattgatagatagatacagatcatagataattgataggtaatagatcaataattgacagatgatagataatatgcaggtagatatttagaccggtaataaatagatagataattgatagataatagattgattggtgatatataataaatgatagattagagagataattgatagataatagattgatagaagatagataatagataggcagatagcttaggaagaattattttcaaaaagtacatgcaaaagaacctcttgaatttaaaggagattacatgaaactgtggatgtttaaggggattttgtggtggactgacaggaaccctgggctagcttccaaagactttggaccttgttctttctgccaggacccagctgtgtcaagtgggatggttctgacaatcttttccactctaatgtcctatgactcaacagtagcaatgcatttccacaggcggtaaaaatattctagactcttcccttccagcgctcactgtttacttcctctgcacttccccttcctgcctccccgtgtgccggtcagttcatagcgggcctcaatgagggtgggttaaccctctctttccagggtgttttgctacggagctccctccaggggctgggaactgtgtggtgagggctgtggttggggttcagcttccttcttaaatcgttccttgaacctttaccctattctgtgcactgtgccgatttccagggattggaaggtaaatgccactgcgtaactcttagaaaatcatcgggggtcagttttactggggtgcacttggtaaccatctatgaatccatgtgtccctctttctttcaggcagtagcagaatcccatggtagccaggtgggtgaaggggagcgaggacgttctacctgccttgaagaagacacctgacctgcggagtgagtgaccaggtagtagacggttctgagggcatcacacacttgagggagggaggaggacagagagggccatggcaccctttgactgctgagtgccagctgctctctttcccactgagaaatgctgcccccaacacacccagaggctctaggtcttgtcctgtgatttctgtccaccaagacttgataggaggtatgatagatgccattaactccagcactatatacacaggactgcagcaaaagcgctctcagcagaaagaggaaacagatacagttcatcccaagcctggcttgctgcccctttgaaagagagtttcaaacagaagcttcatggtgctgccttcataaaaacagggccaagctttccagaatctggcagagggctgagtgcccgcaggacacttgtgtatcactcacactggaaaacttaatcctctgtttttatttcagtggattgaatggcatgcagtttcctcagcagcttaaaaaaaatgcatgcagtcacttgcagacaggctgcatttgtctctgctggtgctcatgttacaagtttgtctgtgcatttgggcatgccagaatggcgtttcatttccaaacctttattgtggtcactttcctcttcgttacactgagaagtgttgctgagggtatagtaaggccctagttcatcaattatatcctgtacttttcttctaacttgatcccaagaacagtggaatttgcttcaaggtaaacaaattttgaataatttatggcccttcttttcaacaaaaatgaaaacgtgactttctaaagaaaagtcaattacaagggggcatttagtaaataacacactcttaataaagtaacaggaaaattaaaatgcccagcagacccattgcctcctgaacaggtgtttgctgctaatggatacagtttccatttccttgaagggatttgcccagaggattactttcacaacttctattgagataatactgctctaacagaaagagcaatgcatgaatctgtatatcagttccttaataaaagggaagatttttttagttcctaaaataccaatgaggtgaagaaaaacatgccacccaggtaaagttactctgtaatcacccgcattatctttttcaaggaatgtgggggaaatttatgtcagtcatcaggcaggtactagaagatgctaggggcctcacagacagcttgttcccggctgttaacatggagcagagcgttccctggggctgagcatgggagcccagcacttcttataggtaggtctttcctactataatattagatgcctacacttattgactttttcatttgctctttaaaatagatttcttctgctggttctgcttagttctaaggagtaaggtagaattttggtgccatacctaaatatcacgtctaaaatgacattggtagcacttttccaagaataaccagcatattgatcaagccattaataaagcctaattatttgctttaagaatgtttttggttgtttcaaactgagttttttccaaagtcataacaaaactaggagaggctgtagattcttaattattcattagattagggggaaaacgaattgctattacaaagaatatcatgcaaaaaataggttttaaaaaatgcattactactgagttttaaaaatgtatactaacattctccatatcaagaactgtttcatggatggtagattttagttatagcagtactggacttacactcagtcaaataattttaaattttctataattgggaatacatggtagctgaatataagcaaacatattactctatgaaataaatgcataagagtttgttatcacaaaaaacagcataacattatttttttgaaacacaaggctctgttttaacactttaccttgtttaatagtaacaaaacccctgaggaataggttgtattgccattttaaacactggagagcaaaggtccagagaggttaaatagctttctgcaggtcacacagctgatgaattgcagagtcagcatttaaccccggtctgcttttctgcaaagcctctgctcctcactctaccctaccgaccacctaagtatagatcagttaatcttgccttcagaattctcctttcttgtgtacttccatgtacattcatacttacttcacatgatgattctattttctggaagttccaccacatatggcgataatgaaacatctttgtcatttctctaagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtccaa

SEQ ID NO: 1019 - DNA, 118480 bp, Homo sapiens
tttggtgtatttttgagtagtccaaagtaatttttattctctaattagtcacctcacgactttatttgaatgaattaatgagaagctaaataaactagctttttaaaaaatattttcttctctttctccaggcaatgggtcactttggggcgctgcagaacatctgtgctttccctgtgccccatcaccttcccagctcctgagctgtagccatctctgctgcacctgctgtcagagggcagctcctccggctcctgctcctgggttgcaggtgccacatctgtgcagaaggcttaggagaagcagtgagccttctaactgcagcagtcctgacaaagcactttgtgaacccctccgggacataagggcatcaaactaggaacaaaaacacagtcttgactgtgatttggtgattttaccacatacaaggcccgaaagccaattgaagacaagaaaagaagacaaatctcttgccagcaggagtaagattgtacaggagtctgagtatacatcagggcaagccaagagacagggacaaacagagagaaaaggttcatgcaattatgaatatgacctggagggggctttggaattagattacaacagtaacagagagttaatgccattttgaaacaatttaagaattatgtatttgaaggaactcagtattatcatgttatccaaaattatcccagttgctcataagacttgctaataacctggactgggggtggagggttgagggatctaatggaaaacatctgttaaaattgaatatgataatcatgtcttgtttttatgatcttgctcatgagacagtcttgaagagagaactgagtgattatccaagtaaatgtgtatttctatgaagaatgtaggtgtgtcttgactttgcattccaaaataaaaatgactgatcttttccattagcacagtttgggtcagcctaactgccagctttcatgattgtatttatttattttccctaaggagatacgggcactttgtgggccttcccaggctgctgcaaaatgatggatggttgggctccgtctaatccaaatgacacggggtgtcaggagcattggtaatcgtgtcctgccgacttcaaagcccactgccaaaacatccacagcacagaggtttggcaacttcacataatcatagcaaaaggactgcaacgtgaaaaaaacaggccctgaaacagctatgaaaagggccagttcagaaacctattcagctaagatgtttcggctagcgccttcgcacggtcaccttgtattttcaccttttgagttgccttcacctggaccaaggttggcagcatttgtgattcaaagaaaagatgcccagggaaactgactctagattatggaaataaacattgtcttcaagggatagccagcaacatcaggctcagggctagtgaatcccaagccacagtgcccaggtaactctgatgtagcaggactaaagctgtctacctagtgagagctcctgaaagagaaaccccgcagcaaatctagacgttatcccttgtttctgtaaagtgagaaattgcagctatccatgacgctttatttgccagtaataatacagtttgccttacgagtggtagcttgttcactgttcaacaaatgtattttaatcatagcaggaattaagggtgatttgtgaccaggtgctgaactagaatttctcaatgacaaccccagcttcataggcctctttccattccaggcataaatatggaggctccaatgtgaaacccggggtccttctgttccaaaaggggctagaaataaaagacaggaggggaggcaagaaggacctggagaggctgacgccatttgggtgccaaacatcctatttccttggctctcccttgcacaagttcctggacaaagtaaattataacacaaaatccacaacattcagcacatgttttcattaagcaactttagtcactaaaaaaagtgcaaatgcagactcctgtataaatctgatttgccatgctaggccaagcttattttattacatacattctgcattctaagaactaataacttcatattgtaaacattaagcatacagagttaaaattcaaggccacattatatcgattgtctcttttgtcgtgtgtctttggctggccgagatcaactcgtagtgtataaatgcataagttatataattattatataaaaagggggaaaaacattgacttgtatacttcattctgacaaacgcacagcgttcgcgactcaaaggaaaactggaggccgcctacccaaaatgcctgcgtgatttctgattgtggcagccaagaaggccatctcttacctgaccctgtggagaacaaagcccccacataatgatgaggtcctgaatgtttctcttaaatatcagacaattccagttaaaattttcatttgacaaacaaagaaagagatgcgcatttttgtttctgaattctactacttcccctttctccattacgctgtgtcctttctcctaacactgggtttggtataacactgactgcatgaaccctcgagtctccataactcattgtacacagtccccaaatgtcctgagtccagtcttcattgcttgagaagtttctttcccagccctggtctcctccttctctgcctcttcctcctccttcttcacccctctgtctacaatcacacgctcactctatacacatcctcagtcccaccttttagttcatagtcccggtaatactgtaaaggagttggaaactttgggtcatcttcacagtttgagaaagctgacagctgtccatcaaacggaatgtatttgatttcaaccaaaacagcacatgccatgcagttgcatatcaacgtctgttgatgggccacagtctctctcgtgtcttttctcttgtttttgatatgtttctatttttaaatacaggtagttttccttaaaatggcattataaacggtatgttaggtcaaaactgtgttgtttctattgctttagtttcatcccagtttgcattagtgggattccaaactctactctaaagtttatacatttcttaagaccactttctttggcactttgtccttaagacttcatgcttctacatacactgtcttttacaaggtcagtccacagatgatatgtccatattcgtgacatttttagcatcctcctcatttctgtagtaagacttcagtaactccctcccaagagtctttggatctcttccccggcttccttccccagccccagtaaagcttttttcattcctcttgaggcacttttgattcatgttctccgatagagtttgtggcgatgggctggtgaatgcacgctgatgggaaaagcctccgccaggtctttagtagtaagtgcccagatgagaaggcatatggctggtggggagcctagtgttggggtatatacccccagttggtgaattccagtatgggtttggggcagcaaaaaaactggaagatgtcacggggagggctggagggtggggcgccacaaagttcatcttctgtgggtgggcgtgataggagcccatgtacgggaggtctgaggggtacttgtacagagatgactccggggggtggggctggagggcctgggcgatcccgtggaagtcgaacttgtaggcgtagcgcttcccatggaccttggtcatgatgttcttgtcatagtagtaacggagggcgcggctgagcttatcgtagttcatgttgggtttgctcttccgctctccccagcgccgggccacctcgtcgggatccgtcatcttgaactccccgttggtgccttcccaggtgatgcagctggagttggagctgtccgacaggagctccaggaggaactgccaaagctggatctggccactgcctaatgaggtcaggagaggaaggaaaactccagtgagcacaggttccaggggaaagaggctctctgtgatgacggaaggaggtgctattggtgtgccgcccacattcccttcaccaggcctgtccgtccatccctcagctgcaggggtgcggactgctctcgttccatggccacccacttctccagagaactgcccttgcctgaacagagccgccgcctcgcccacccccaggtatcccacagctgggtggactgaacggggtaccacgggccggcccccttgcctcaaggaaagaccaactccatgacgctattcaggcttcagggctcccgtgggattgggctgaaacagcgtccagctgcaaggaggcttggaggaggccagaaacttccttagcgctgcccctgcagcacttcccattctctctctcctgagaacatgccgttaatcagtcacctgcacaagcaggcttaccccaagctctgcatcaagggaacccgacctaggacgatgatctaacagattcaagacctagatggaatgcagcgaattcatatggggcaaagttcaggctgcttccatccatttctgacgtccttaaaagaacagccagatcaacctggtgtttaggggatgaaagagctatatatttttttttcctattttgtgaagcacaaagtactgttatgtggatggcaataatgacttaatgccatttatattggctaggtcaagtaagataataaaagttagatttaggaaatgaacttctaaaagtttatggaaaaaaatcgagaatggaagtaaacaccattatttctaacataacattttgctggcgctcagaaagcaattctgtgaaaacttttcctagaacagaattaacccactcaaaatgaggaagtttaggaaaaaaaaaaaaaaagctggctctttttcaaaccagatcacccagttccagtatttgggcaagcgcatcgtaacggaaaccagtgccttgcctgtgtgctgcaacgccaattgtgttaagcagcatttccagaagaaaaaccccaacaatgagtgattgcaagtccccttgggaagctgaatgagactcttcctttgtcaaagagatcacatttagctgggtggacaaagtcagaattttcttgatttcattgaaatcatacagatacagctttgttttatgaaattcaaagaaaaatctaggcacatcattctagctgctatgttacaatacttgaagatagtttatggctccctagaagacagcagcatgtaaatattgacagcagtatccgtaccaagagaagctaagctgtgctgaacatatttcagaagcttaagaacagatgggaggtgggtctttcctcccaaattccagttacagcactgccttagacttattaccaaaagattaccttttattatagtgtaagtaatatcaatcgatgtgataaaatgattaaagtaactttaactgacatctactcagggaagtaatatactgtaaaaatcaattttacgttcattttcttctaaatcctcgctagcctcctgtacatatcacccaacttataaactctgctttgcatgttggctacatggacatggatatttttgtgaatttatccatacaatagcactgtgagaaaggtcagctttttctgaatctatgctggaaagtgctcattttcagtctagcaacacatttgaaatgtattaacagcttgtagctcattgaagtggaagcctttgctttttcagaaccacatatacaaactgttcccaatcaagttttgttgcctccaacattttattaatatgcatttagaaaatacaaagaatggtatgagaaaaccatatggtcttagtatatatattgtaaccaaaaaattacaacttgaaaaaattccgtatatgacctgggaataggaaaaggcatggatttttgatttaacagtctaacagatgcttcaatataaacacatacggttgtttgaaaataaatattcagcgtcaactttctcccatagagaaagcaactccacagacctgccgaaatcacacttggaatctactcaaaccttggcattgcctcttagcaatttgtccctcacccatttctcttataaacgtgtgtaggacagaatcagtggacaaaagtgatctcatgtctctcctatttctgaagagttagaaagcaggggacctaaatttgtggcagcaaactctatgcccaaaggatggatgagctaatttctcacttgactattttacccagtagccataaagacatagggctcaggactgtgagaatttcaagggagggtctatagaaataagagaactgtaagcaaaattcatcagctttcaaaccttgaaagaaacctggaaatgcaaaatcaatgaatgtttaagtaaatggtagaaagagtaacatcatgtcaaactcattaattgttaaatttaatatttgtaacaaaattcgctgcattttgcagtgtgtagaacaaaatttctcactgcaagaattctcaaaaatgaacaatggttgttaaaaaattgtcagtggtaaaggaattattctcagtcataaaattttaagagcaatttttaaattcttattttacttccaaaacaataacatttaatgtgtgacgaggtgcattttagaatatagaatagagatttccaaacaagaatgcttagggtttaggaaagcctaaaagtggcttgggtcactcatgggccaaaccaggatttacaaagagaagttcttgaaagacaagagctttcattgagtagcatcaccacctctaccttaggactcacctttcttgggtaaacccttcagatctattttttttttttactctctcttaataacatccttgcgatgtcagtaaggaggaactaattttttcttagggtaattaccaaaataaaacatatttggaggtaaaaaacagtggcaagcagcattgtccacctacagagaaccctgtgggtgaaagggagcggctgtggcttttaagaagacagaggcactcctttaattttacagaggaaagtaatctcctaatattgttaaaagaaagggagagaaacagggtagcaaaggggtacagactgagcaaaaaagggggaaaaaaaaactaaacggtttacaaaccacagagcaaagcagagagctgcagagtgagtcagcagctgtgtctggtggaaacagcatcctggtgcaaagccctgcagccgtcagctgatgaacaagggcagtaaatacagccgtgaggggccccaccagtaccatgtggcagtggtttggggccactttctctagaagccaggggtggtgcagaagatcccgtgtgcatggcctggaccctctgcaaggcagcaggtgtgtccagcaggtgtgtcctgaatggaagtctctgccccgaggctcagtgaggctcaggcaccacttactggaggggcaggaaagcatggtggtagggagcaccaactttggagttgccactgcttcagctgaatcctgcctctgccctttgtgggacgtttggcaactctcgcagctctctctgcctcagtatcgtcatctgtaaagtgggggtgatggtaatagtactatcttgcaagatcatggtaaggatgaactcagtacttgaatggtcttgtcagaatttctttgggctgaaaatcagagtttaaggaaagataacactcctctcctatagccaggaaatgcctaaagaaagagaaatactgttcaattggcctattgaaccatgaagaagcttgaaacggtgctattcttgggctgactgatatcctctgaaagcttactgtgtgccatgcaccattctaaacgctttacatgtattggtttatttaatccccacaggaatcatgtgattagtccattggagaagtgacgaaattggagcttagagaggtagactgacttattttgcttagcgttggcaagggttgaaatccagactctaggctgccatgcttaatcactgcgcaaacttgctttcaggcctggtttatgcacacctctgtagcctcctcaggtcctttccatgttgtcccctccctgggggactcccactggaagactgcacactgccacctcctaacaaatgggaaaacatccctagcctggtctgtcgttctgcaagaggcaggatgtattttcatgtgcaccattgaagagtatccagttagcatcaaggaagcctctgaacataacccaccaaagctctttcattagaggaaccatgttagatagattctcagctgctctgatgggatgtaaaggagctgtgttgcttataaccgatccatgatatcagaatgcagggacacactgttctcagcaggaaaagtgatgtccaaagtacacatcaagtgaatatttgggatagagatgttgggatgctgacatcatcctgtgcattcatactatatgatgcaatctttccacttaaaatgatgaaaaggaatttgtattgtatgaagagcaaagacagcaatttttaagtgatgaaagatttatttatcagagaatagaaaaatagaatcaaacaggaagaagcattgtcattaatacaaagataaaagacattctggtttcaggggaaaagttcacatgagcacaacagacacaaacctaaagatagatggagagaaagtcaaattcatcagaaactaaatgaaataaatctttatcttaaagtcacttgcctgcaaatcaaagatgggatgttgccattttctccaggcccattaagaacagtcttaatggtatgaagcacagtcctccttccccaggcctgtgatgagtttccggtctccttgctctgagctcaggtccctctatctacaaagggcatccccgggctgctgggcccagggcatatgcagtgttcccttgtgaaagctggcactttgcttaggagcaagtgactcaggccctattctacaaacaagccaagcagtacctttgggctgtgacaacgtggtcatggacatatatgtttcatttggccaatgtgtgagtgcaaaggccagtttggtcttctttggtgcagcttgactctttcctcctcttccttcctgacctcagattcatcgcctgcacctaagcagttatgaccctgaaaggaaatccttgctttctattctcacagtccgcattttgtaagacctcctcttcccttcatacttagtcagtggcagagtagggcaagaaaacaaaagtagactttgcagacagagtcaggtttctaacctgacctcccttatcattggctgtgtgacacaggaaaagttacttaacttctctggacttctaattccttttctgtaggatggagatagtaacctcccagggctgttatgagacacagaagggaccacagacattctatggggggcattctgcgggatgggagctgtttgattgttatttcacatgattgtattaacattcccagagtgtttcagcttccgtcattttcttttttctaatctatcctgaacattgctgccagatcagtcttcctgaagcatgactgataataatcatctcaaaacatagtcattatttttatttgaatggttatatggcagagttgcaaatgaaaagctgagcagaaggctgagaagagaccacagcctcaggagcctgggctactagatgaaagccagcatgagcaaaaagggcctgtggctctgtgtttgggacaatgttgtaactacctgtgtccatctctccacggaccaaaagcaccctgagctaaaggactatatctcattatccttggcattcatgtatgcaacaaataattattgagcacctagtctaggccccaggctaactagttttctttagattttcagctgtgtaaaaaaaattcattgaattcattaacattaaccaaaatttaacttcaaaaatacagatgttcaataatgataacatttcgtgttttcaatgtgtagattctcttgcagggatgtacactgattaaatcttaattattccatttcgaaccttattttggcctcaacgtttaggaaatacacattccatcttgtgcttgcaatatgcctgtaacatcttggcatttgaatttgcagttgggaatatgcagcataggctatgaatttctgaagctggtgccagcacagctggttctgatctgaatacaaacaaataaaactatgtggttggcactgaaacactaggacaggtgacaaaccttggcaatgcactggttacaaatgggctaattaagaatctgcactttcttctagcatcgaagttcagaaacagaccatcgaagatgagcctgaatttgaagtcttgtggttgtatcaaggctctcttttaaaaaatactagttattttatctgcttgtataatgggttgaattgtgttccctcaattccctatgttgaaatcttaacccgcagtatctaagaatgtgaccttttttggagataagatcctaaatgaggtaatcaagttatagtaaggttatggggtaggtattccaacctgaccaatgtccttatgcaaaagaggcatttggacacagagactgacacacacagagagatgatgatgagaagagacacgaggagatgatggctatctgtaagccagggagagcccccaggacagatccctccctcacagccctgagaaggaacgaaacctgccaccatgacactctgatttcagacttccagcctccagaactgcgagacaataaactgttgttgtttaagccacctaatccgtggtactttgttacagcagccctagaaaactattacagcttggattaggttataatgttctttgctgaagctgaaatcttaatttataacccaacccatctttccattaaggcaaataattcagtgagacctaaaactaaaatctgttcagttgaaggaatttctcaccaataccaatttacttttcaaaataaccactgccaaaaagtaattttgtaagaagaaaatcatcagcagtttctcacctggatttgcaaggcggctacttgttggtccaagaatctgataaggatctacagcaaaaagaaacaaagtcaaatcctagacatagttgtaacatagtatgatgtgacttcagacataatgcctgacttaattgttttttcagatttcagagccgaaaatgtcctccaactccaaatcaactgcctccacctcctctatgagagaagatgtcacacggcatctcagatgtcttgctaggggactcctaattggtggcagggcttggattcaaccccaggatcctgacatatagctcaaggctcacaccaaccaatgatataaagagggcaaacatgtgccaagccccatcaatccagggccgtgcaggctgtgttgtttaggcatggaaagtaaaatctaaaaaattaatggatcacaaagaagcagcctgtgtgcacgtagaatttttttccctatttattgcatagttggggacgtgttttagcaccatctcaagtcacctcgcatgagtaggctgatgacttgggccctatcttatgtatggagctgtcgaaaagaggcaaacaatcatgttaatttccattaaaaagtgaagcattttagaaatgtgctgctgagcctgaatcttctcttatggttatccagacggcccctgaaacatacctaactgaggacgctggtcttcagttttgggcactgtggaaggagatggttgagcagctgaaaatccagaaatacaaaaggcaattagctataacagatttggtcactagtctttgatgttgttgcataatcattctatcagttaatttagttattaacataatagtctaactcagaagcatctcacggtaaggaaaaattttcctttctgatgaaatcaaatgtaaacactgtaacaaaaaaagaggacatttccaattatttaaaaaatggatacctcccactttttccaaaagtaaaaaaaaaaaagaatttggaatggcttaccaaacagattacaataaatcatagtctaagataaacacataaagggaaaccaccagtcaaataaagtaaagccagggatacttttaagcatggccaagattcaggaaaacaccgattatttaatgtgtactcaaacatcccatgaaacatgcatttgtgaaggttgacatacactacatcattcctttatttttgttatgaaagtcctgatgacccaaatggagaaagaatcactgcagtgaaagatcaattgtactcttgtcgtcaatggaacaaacccatcacatgttgcaaaatcacagattaaccacagaaattattatatactccatcaacagtcatccactgcctgtgacatgaaactcagggtcatgggagccaacactgtacctttcgactggggcgtggggtggccgtgaccggtccaggctgatctcctggggggctcatatggtaaatctgtaaagacaaataaattgactaaaagatcaatcatgtaatttttataagagatgctttggttttttatttgattttgtatttattagaataaactttgtgcaaaaaaatctggtaatccaaagaaatatcccactagatttgagttttatttacaaattaaaatttcatatattatagtggtctaaaattctcacccgtttgtctgaaaacttccattggcagattctcccagagctttccaactcttctaatttcctacaaccataagtcaagaccccaataaaagtttcttacaatctagttcatcctgcttccactgggactgatctacatctgtctctttattatcttcatgactcatccaaagcagagtctacaacttggatgaaccagcccatttttgtttgaggtctgttcctaaatcaatcaaatgacattcagcttctttttcttcttgcatctcctgggaagtgatcgctgccttatctttttatttgccagctgcctctcttagccaactcccattttccctttataatctcatcaatttatattaaatcagtcttatctgatctagtgattttcataggcaaatgtctcccatttctaatgttctaaataaatttagaatttctctaaaatgacctgcatgaaatgaattacaggactgaaatagtattgctcccacagcccattaatgatgaccttctgagcttaagcatatgccaaacatttctttgtatttataaagtcgtatcacttgtcctataaaccttcatttacttttcatatgcaaatttaataactatacttctgcatcctcagtgtgagttctattaatgattatcaaagctctatgtcatttcaagtttgtttcaaaaatatattacagaaaccttattataatactcttgctaagagtgcatagctaaggctatttctacatgcaatcttattacataactgtttcaaaattatgtcttcttggattgcttggtctcagttcaatgtcatgtgtcattctgggccaagtgaaggccatggccaaatatctcagcaggtactttgctgccagacaccaggagatgtgtacaaaatttcacttggagggtaggacaatgcaattgtttttaagcttctctttaaacaaatattttaattttgtttaaaaccagcaatttgatgggtcaatcttcaaagagcttgactgtgttgcagaagatgtgtctcttcctattttcatatcccaaagagaatagaaatgatgcgcaacgtgaaagtcaacacagaatctccttaatgtatttggtctgtttggctgcaagcatctttgctactagtgtggtctatgaaatcctacccttcagagctttggagaattagataatttttctttttaaactgatgttactcctctctctcagctggcatttttgcatttttggacgtaaatcttttcccacccagatcctcagattttcacatctcttgtgttggggttacacataggaattatatctgcagcccctaacaatttacaactgaacttcaacttaagtctctgggaacactctgcacatgggttctcagtcagttgcattttgtctaaaataaactggacagccagagtttcaatttgcaaattgtctcagaaagaaaaacctactcacaaggcaatcctagccacatctaacctaatttaggagcagaaaagcacattaactaaggccttctatttaccaaatgaaaaaaagcaagataatacagaaatacagaaatatgttctagatctctgtttctcaaagggtggtctgtggaccagcaacatcaacaatacctggtagcttgctagaaatgcagaatcttaccccagacctactgcatcaaaatcagcattttgtttattatctttttttttttttggaggtggagtctcgctctgtcccccaggctggagtgcagtggcgcgatctcggctcactgcaagctccacctcccaggttcacaccattctcctgcctcagcctcctgagtagctgggactacaggtgcctgccaccatgcctggctaatttttcgtatttttagtagagacagggtctcatgctgttagccaggatggtctcgctctcctgaccccgtgatccgcccgcctcagcctcctaaagtgctgggattacaggcgtgagccaccgcgcctggcctcagaatcagcattttaacaagatcctgggtgactctggtgcacactgaagtctgagaaagcctgctctagaccattgctcttttcaggaactctgttcctgcagatgatttcagaaatgctatctagagtgtgcaaagacaaactaaaaaatggttgaaagagttctagatggattgcttttacccatggcataagtatgctaatggaatgaatagacagcatcagtaggttagtcagatactaccttaaacataaaattgttgctcatgaaatgtgactgggaaaaaaaataaatgccgaactactattcccaaaatattttgaaactctttattcacaaaatccttcatatggtgtataaccatatcccatcctccctcgaaaataagtcgaaacttaacaccaaacagtctacttttcagccaagtatttgagacagttatatgaacaatgattcacatgttcataaacatattgccgcggaagataagtgggcttttgttttcttccatgacattctggtccaatgcttccttatcggctaccgatcacatgctgtgggcactaagtatccccctgtgggatatgacattgggaaacattcaactcaggctcactgagatgggggacagccaggggtgacttctttggcagctacaccatctcaaaaccttcgtagttctgctcttgactgcttgaaaaatcactcctctatgtatctttgctatgtgtcctttattgataatagagcatcagacttccaataagaatatattttacatttaattttcgctgatcatttcaacaccctctccatttctctttgactttgatcttcaaggcaatgaactcatatgcttggcagaagtgcccatgtaagggaaggctgctttctggcactggttctgttgttttatctgtaagagactgtgtttaaaaactgagctttatagaagtcattgcataggcagcttgggtgaacacagatgtacattacatcacaacagtataaaaaacagcatgaagctacaaatagggactcggctagtgctgaccactacacaccagcaactgtgtcgatttcctgggagctgggatcagcttctcattctgaatgagactcctcctccaccacacccttttgaagacatcactaaattaatacaacattctggctaccctttcctggagggctaagttcagccaagttttacattctcccttcatcaaactcactgaggaggaacgctctagctcttgccccacacaccccacaccgccaccccgctgcctacccgctttattttttaaagggcaagaatgtggatcgtggaagagctcatcctcattctgcaggatccacaccatatctgcaaagcaactctggaggttccctggctgggctggatgggaacagatgagatttgcctgctcttgaaattagatgctaatggggaacacaaattaggaagagcaagagctgctgctaagaaccaatctagaagtgtctgtgaaatgaaaaaaaaagtttgagtcaaccttaacataattaagttgctctctattttcctccagatcttcttaaaattctacatcaaagtttgagcatggagttttggaaacattttgcattcccttcttgcctaggtttgcatatccctgtggttatataagaactaagcggaagcaaagaatgcaattttagccatttgctaagatacaggctttacataacacctaactgagagatgctatgcagtagttgtattgtctcactatgcctagctgtgctgaaaagcactaggctgtgagctccaatggaggaataatttaagattccaagaaacccctgaagagcagcagcttcaaagtagaagcaaaggctgcatttgcaggcttaactctctaatctcttttgataacaccccagaggcatatcataatatatgggttgtcatggggatggaagaggaaaggatggggttgcagaacatcatccttgggatagaactgagcttttgcatgacctgctcctaagaggacaggcagggtggtgcactgtgtagttaataggggcttgcaagattctgtggatctgtttttgccactttttcccctgagacctcaaagggctatggctccaaaagaagtggattcagcaaaaaagaagggtgtttgtagaggaggtacagaaagggattctggtcgtagtaactgcaacaacgtgagaaacacgtgaaacatcataaaataaagtataataaaatatatatatatttaaaaaatcataaaaccacagaatgtaaaatgatatgcctatgggttgatactttatgagagtagagaagactgtctcaatgctaattcaacaaaggggttgtgaaagaaggtaaatcttgaatcaggaaaacgtgggaaaatactaggtacgggcatgcaaggaaaagggatgaggtttggacaaatggcaggtagtggtggtggcagggcatgttcacatgtggtcccctgtgaggtcagtgaacggcctcggccaattgtgcagggagactgaactgacacagcagcagcgagactgacctgacagggaagcagtcagggggctctggaataaatgatccacttgggaaggtgggccatgaacagaagaaaaggtagattgggggctgggcatggtggttcacgcctgtaatcccagcactttgggaggcagaggtgggcggatcacgaggtcaagagatcaagaccatcctgaccaatatggtgaaaccctatctctactaaaaatacaaaaattagctgggcatgatggcatgcgcctgtagccccagctactcgggaggctgaggcagaagaatcacttgaactcgggaggcagaggttgtggtgagccgagattgcaccactgcacttcagcctggcaacagagtgagactccatctcaaaaaaaaaaaaaaaaaaaaaagaagagaaaagaagataaaagaaaagaaaaggtaggttggggcagtaacccagggatgggtgactcacagtgggaagggaaggagggaagggtggtgaggaagtgctgggaaggtggatgcagcaggacaacacacatgtgtaggagtctctgcagaaagggtgcggaatgctgtctaatttaaccagtaaaccctgaacaccactgtctcctctatcagggactctataatgaaacggccaccatgcagagaagagacagattctggtctaagtagagttgttacctaggagcctggcttgcttcatggtcagcacaataacgctgaccagagttcggttccctcggatgtgggattagacaaagggtatggaaatgaagatcatggcacagcaaaccaagagtggaggagacagggatttgggtctgtatccccaaggaccttcaaagaaacagtcaacaatcacctttctgaaagtagtcaggtacccactgaccacagggatatcgtcagattcccagtgacctccctctggagctcgttcagctctgaaagttagtgatgcaaaagctcttccccctcagccatcacgacgttcattctccagttgcaggttcacagcttttatctccacaggagcagtcctttaaggttgatcgcttagcaatggatgacccgaggtgtataactagttcttatctccaagttcaagtccctgaatagggcctacagtaaatagtcctctggcttgttcagtctgctttaaattctttacaggtcagataccaatatttgtattggttctcataatcacagtagcagtggtcaaaacaggttatttcaggtacaaactgagtcgcgaaaacatacttgactagtagtggagctgtggaagtgtgctctctcccaggtcacgctcaaattatgggcccatggaagaccaccatcagagcggcatgggaggtgtctgagtttgccacccttgccttccctgggttgggcagagagggagtcccaaccaacatcctcacagtcaccctcttctccatccacctggatgggccataccttccaaatccaccatatcctaaaatgtgaaaacaaagcagctccaggacccactgtcttaaccaggtagcatcagtcagctggcttgtctgacagagagattgtgccaatgaatttggccagtgttgtgatcttttaacacagtttataatactagctcacaacccctggctttgcaactcagtcagaggcacctatgagatgtcttaacataaacaaacaaatacaaaattaaaaagtaaaaaaatttttaaaaccctagccaaatgttttggaaatagtttttatttttttagtttatatggaaatattttttaaatgctcacagaattacaaaatctctaaagcttgagtcaaacatgaatttctattttccactcgcaatacacgtggtggatgtctttaggaccaatcttgcagactctaggcactgggtcttgcccatgtttcaatggcctgtgaaatcttttacatgacagagatgacttactacctcttagtaccccttagctgctaagcctttccatcatgcttcccaggagcaagacagtaaactttttctctgacgttagagaagagaaaattgccagcctgaagtcactaggcagtaaccagggcagtgtcagtatttgaacagcctgagaagcttcctcattcattctctttagctccctgggcccccagtctttctcattagaaagaaagagtagttgccaagcctagatcttgaaccagttcgaactgagacttgtgtattccggatatgtgatagagtttaacatgaattctggaagcatgtatgaatatggagaaaccatcccaccaccctgaacacaatgtcatcagctgtgaggctggtacaatgatacctagcttatcgggctgatgtaagtcccagggagaggacaaatgctaaaggcaagctatacccttctgggaaatgccctctctccctgctcattattcgtctggcaaacatctaattcccctttgccatgtggccattcctctggaaagcatctttatgcctttcatgggggattgagttcctccccacccctgctcctacgccctgtattgctagaagtggttcctctaccataaaatctatcacattagggaaaacatttatgtgtacatatgtgtctctctggctctaggtcactctactgaaacatctagaactggaggcaaaacatttcggtttgttcaccatcataccatccgtggctggcacagaggaggcactcagcaaatgaacaaaccaagctgaatgaagaagtaaactttctgaagacaggaagcttactgaagcctggttcatctatatattcccagagtctaacaccacgcttggcactaatgggcacttgatagatgtttatttttgcatgaatggcatgtaaatttattacctaattaaatcatttggaggacaggcagtaagattcagatgtaaatactactggttgcatgcttctgctctgcaagactggcttcttgtgacatactgataatcggtcactgtgaatctggggagtgtccttgttttgtgctcttcccccgaggagggacagatccttctgttagttcaaaagtcggcctattcctaactgccaggcatccaggatgccttctttgcccatctgtctttctgaaaagctagttaaagggctaatctgctcttaattcctttagtgtggtctttgaatgaaatggtttgagtggatttagtctccaaatcaacagaggcagaataagactgtctgggactggcttcagctccgggatcagctctctttgtatcacgtgacttagggcacggatctcagcaggacatctgggatgtctctcaatgaagagatcacacaggggtgttttcgtacctggcctagttgtaattctttgcgtagcttcaggatatactgaagtatttgggaaaataaaagctgcaccccctgcagacaaaaggaaagacaaacatgtgaaggtcttttgttgtggttgtcgatctcaacatcagcgccaaatctacttttccctatgacaacaaagggaagagacctcctcaaacctgccttaacagagctccggagaaacagacaggtgcacctgtcagattctcaagatggaagtgaaacttggagccttggtgtactcctgtgccccgtttgctataaagcgttttgtgttttgattttataacttcttgatgaagccctatctgtgtccccctcaatcccacttcccactgggcaatctcgttttattaaaaaattatatggtacatgttttatttttcaacttgtataaaaacccataatatattttacagagcttttggaaagtagtatcaagcaattataagtatttagcctaagagtatatggattttattaataattaatccacatctctattcaaatgcattttccctctctctcttttgaccaaaactcatgctgttagctgagaaaattcccttttcatagttcagtccatttggaatttgttgtcttgttcattggtttcttccgtgtttaacaatagcaaaatttaatatatttggagcttttttgaaactttcactcaatggttaaagaactcataaataaatgtgaaattatcagaaaatgtgcatagctcaaaggtgtttcctaagaaggggaagtaacttcctctaagttatctgttatttctggccacaaggtcactaataggctgatgtgtgcaaccaaaattattgaaaaagtgtactaccaactcgaagcaggttttttaaaacttcagattaaaaagacaatgtgttgaatatagaagaccatgataaatgagcaatttcattgtaatactcaaaccgggactcactcacattttatattttaaaataaaatggtaaatattgggaaaattgcgtatttctatgtgagggctgatcgtgagttaactggctgacttgcaaggctttctggcacttcccgtctccctccctagcccgagtgattgtggagggtccctgcagctaacagagtggggtgagcagccggtggccatgcttccggaactctctccatcaggaaggagcagatggatgtgaaccaggaacacattcatccacagaaaacccagcctctgctgtgagcggggggcgagggaggaaggttagccaggatgaggcacggtgttaaaccctacttaggctcaggcaaaataaatacataactaagtcaaatgtagaggcaacggttagagatagaaaacaggcatttggttagtgactaatttcatattctccaaaattatagcagaggttccctctgaacaaaagctctcaaaatgttacagaaattccctcctgccttttgcaaacatacaaagtctgtaggaaaacaaatcaaatagcctaaaagtttattggaaaggaaaaagaaaattccaacttatcctagcaaatatttctttaagaataaaaatggaaaaaattaaaggaggttgctaagggcccttttatatcgaacatgcttttagtgtctacagagtcagcacagcgaatatattgggaccaacagaagaagactgtaatccggcaaatgtgagctaagttatggctaaaggcaaattctgcacgtctcctggttaaaaaggaaccctttgataatcaaagtggggtgcttgggaagcgctcagaaaaccaaagggcttcaccttcctttaggctgtggtacattcctaagtatccgaaagtattctgaatcatctacctgcgttctgtcttcctggcacgcgctgactggtttcccatgaaagcatgcaacctgtacgtaagaccctacgctcttgctgggaggcaggggcggggccagcattacctgtgtttctagcatgcattaaccgtggagagttttgtaaggctttatcaacatcatctgaagtcaaatgtggaagaggagctacaaaacaaaacaaaaagcgacatcaaaatgaaaaaaaaaagagagagagagaaagagaattacctttcttacaaaaaaaaaaaaaaaaaaagaaagaaaaagaaagaaagaaaaccgttcccccactcccacactaacatcatgggaagcttataactatttccagcaacctgctacttgttagcatgttaaaacctacatgggggcccgtctttaattcagggaagaagtggttgggatgccaggcaaagcaatggaggagaatttatccacctcactgtctgtcacactacttccttctcaccatgctggacgttgtagaaattaaagcatgcagcaaacattctggattcatgccaacatgccatccctttctgtcaggttaagccgaatcacatgatacaaagtgaaaacttcccttgttctgtgctcaggttagaatataaagtggggcttcatgtagctttagggagaataatccccctaattcctacgaaagagaagccttaatgattctatttcgattcggggtatcatggagacttaactaatgtgtgaccagttaacgcttcctttcccctttgacattccatcttcttggtcgcaggaccctggaggaggcagctgagtgttgaagtgaattttggcttctcctgagagcgctgactacttctcatcaggtgatgtggccagggtgttgctcccctaagtcatcacataccaagcatgtggctccctcggatccccagtgggaactgggcgagggcaggaggatgctgtcgacacacctggttgaaccctctgaagctcaggtcataagaaccatagccacagccatctatccttggaggaagggggagcttactctctctgaggtagtggagatgtgagagaaggatgtcggcgttgtagctgggggtgagcctctggaagtcgtccttggtcatcttgcacagttccttcccatcgatgttctggaataacaagatgttgacgtctggaaggccatattctttcaccgcccactccagccactgccgcacatggtctgtactccatagcgtaggatctgaaaggggtgggaacacattcagtcaattcctgaagccagggatcttcatcttggggtagatccccatccacgtgggatttctgaccagctgccttccacaagcacagcctccagccagcctccctggctacccaggagaacattttgggggaaagacaaaagctgcctcacatccatagatcattgtctttaaagtgaatagttctggaatcttgggattattcacatcacatgcccttgtttttgctcaatctaaagtttcctgtaggcataagattttaaaaattcttttttctcatttatgttcaattttatttatttattttaaaatgagtaagaataagaggaaacttcttttccttagaaaactactggtatatttatatatatttatatggaaataagagtaagccacacatatcaggaaggtgctaattacagatcacaacaacaacaaaaataataataacagtatttatgcaaaatactgaaaaatactgaccacagaatcggaaatgaaatatagatacaccaagactctagcccctcctatgagccagcgttcctcatagagagctgtcagttccagacttttcctgcagggtgtttggttttgcaattaaccagcacctgcaggagtggggttggtgagtggtttttgcattccacagctggccatggcgagcacaaacaccccacaggatgcaggccacgtcgtcacactccagtgctacctatgggacagggagagcagggcccgggggagaaggagcaggtgatctccaacagaaacgccagccgggatgtcctgtggtaaacaccctcagtggtagggtcttcagagtgtggtaaatggggcggctgctcccttgggccccgagccctgagagacacatgggcagggagttggagccctgagttctaatctcaccatttctccactttctggaccttgctgtgggcagctatttctcctttctgtgtctgtcccacctgtaaactaagagcactgatctcagttcccgggacaagcccttaggggtcaggcatgccaggatgttccagtcctcttgaatgaaagtcaggtgtgggagtcacattttagctaatactttcagatccttgtttgtttggtcccactaatattttaggctactcaagaatggagcatgtagtatgctgctgcaatacatttttaggtttgcagaggtaaaccgtaataatagtgagaaacagccagccagtcatacacccagagttctcttcctctccctccttccctcttccttccttcgcttctccctccctttcttcccttcagctacatagaagaaagaaattattgcaggtccagtagaatctacctttcccattccattctcctactgcaaacacctatcctgaagttagtagctagtggttagaagtaaccactatcctgaagttagtacgtgtatcactcctatacatattttaatatttttaccatttaaactacatatattgttttgtgtttttaaagttaacataaacgatatatgatttgctattggcactcaatgttataatttcaagatgtagccaaatgaattcacaaagatatactcaatcattaagcagctcttaggcctcccccatgtgaataatctcaatttatttagtgaatgtcccctgtccatctccatgcatacgcgtgaatgagtccgcattggtccagggcctggggtcctttctggaatcatctggggagactgaaaaactagtgatgcctggtctcccctgggagagtctgcttcaattaggctggagggcagttgggcatcacagttgataacagctcccccaggtgactctaatgagcagccaaggttcagatcatcttccctgggcctcactattccaagcgtggtcctccaaccgcggaagcatcagcatcacctgggagctaattagaaatgctgagtctcaggccccacccagacctgctgaaccagaatctacattttcacatgaaacctggggacacgctggccttggctgagtacctagatacgggatttctgagttacagggcacatccatcttcaacttgaccagctagcattggatgtctaccaatatttaaacacccacattctcacttaaaaatcagtgcacaggccaggcgcggtggctcacgcctgtaatcccagcactttgggaggccgaggcgggtggatcacgaggtcaggagatcgagaccatcctggctaacacagtgaaaccttgtctctactaaaaatacaaaaaaaaattagtcgggcatggtggcgggtgcctgtagtctcagctacttgggaggctgaggcaggaaaatggcatgaacccgggaggtggagcttgcagtgagccaagatcaggccactgcactccagcctgagcgacagagcgagactccatctcaaaaaaaaaaaaaaaaaaaaatcatcagtgcgcagaacctgaaaactaaagggaactctggttttgctacagagagaatatcaacaaaaactccaacggcagtgatgacagaaaagtgtacatatttatttgtcatccaaacacttggaaacatgttgttagtctgtgaaaactgaatgtagatatggaaggttaatgttatccagttcactgaagttcagatgactcttcgtcattggctgagaatttggctttcagagataaaatgtttcttttttcatgacatgtcagaattcctctttctacaaaaatggatcatactgaggtcttagggcaagttctctttacctttggttctgtgcagaggatagtttgttcagccctcacagagagaagaccccccatcctacccaagtcattccctgtaagttccatcctttgatgttagcgaaacccacctttttgttttgttttgctttgcttttaacaaaatgggaggactattttttttttaatgtaacaactgtacttcctagaaataagttcattctgggaacagactttcttctctaaatggtggaaccggatattctcaaaatgacacataaacatattgtctgaaagccactaggttcgtgttaaaatggtgaaaggagaagtttaatctctctattatcccttggtgtgccccttaattggtttcgctcatcaagacaagggttatcctggcccattcagttttcctttaagggaatcaggtgcaagaccccagagacaaagtcctcaacctgtattgtacttatctctacaagtctcactttgagttggtaaaaggctgttctggagttccggagttctgccaatatgagtataaattactacagcctttctgatgaacaacacaataatacaacaatacaacacaacaatacaatcaaacgtctttaaatatgtgcagattccctggcttaaaaattccatttctagaaatttatcctaaggaaataatagaggatgtgcgcaatgatttattgtcaaggatgttctttgtagtgttgtttataatagcaaaacattggaaacaccctaaatgtccagcaaaagagaagcagttttgtaatgcatttaggaatgttcctgtgatatttagagactaaaaattacactgttgaaatatatttattgatatgataaaatgttcaaagtagattgcattttaaagtttcaaaatattattatgatatcattgtattttgcaaagatatataaatatctgcacagaaagaaattcagagggagatacagcaaaacgtgaactgttgtcactgagggaaaggagatggggaattttagatttgtcattttcactaaactatattttctcatttttctataataaatatggaatacttgggttacaaattatttatacaaaatgtattctctatttttcaaagccaaaacatggtcttacaaaaggtatatatatatttaatgtatattatatgtatactatatatcacctatatataatatatgtgaaagtatttttataaaatactttaaatactttataaaaagtattttttaaaagtataaaaaataaaagtaaaaaaacaaaaagaaaagttaaaaaaatgaaactatgcaaagcattttataaaaagtataaaaaataaaactactaaaatactttataaaaatatttttataaaataataaaatatataatatatatagaatatatacttacatatatgctatatatactacctatatatagtatatatgtgaaagtatttttataaaattgctgtcaagagtataaaaagttaagtttcagtttcttttatattttgttaatatagactgcttcatctgaaaagagtaaaattacatgaagtcagaacactcccacatccttttagcatttgatctccacacctctgccctataaatttctaagcaaacaatggtgaaaacaaaacatggccactcggtagaagaaatgagggcattccttttctcctgagcactcgcaccactctcccagacccactccggaggtgttgcaatagaggacagtttgcaggggaaaaacccagattccccagcatgaagcacacagtcctttgttccatgggtgtcattcccaaccattccccctccaccctacatttcctgagccaatgcctccatgcctgtgccacatgccacccacagcgtgaaggactagcaccttcttgtgccctcacctacactcacgacctcctttgggcatctgtcctagatgttctcacagaggaaacacttaacaaatctctgggcagtgaagtgataacaagactgaagacctagtctctgctcacactgaactccacctccactactttggccaggcaatgatgctgcagctgtagatgatggtttttagagttcaggtcagtgcactgggtccaggctgtcaggttttggtcctaaccttttaactccatgaagagccccagtagtctctctagtctcctccacactccatggtatctcagcaaagctttatggcttctgtcacaccaggaatcaaagaaaggggctcatgagttcctatgagattcagcaggcctgtcttcctcctttcttgaccccaaccacacatgtgtaggaggaaggggaggggactacagcataagccccagccgaggcatcacctttgcctatgtttaggtgcgaccttctgccctaggtaggaacacctcttgtctccaggtagcagtgtgtttggaacctgtcatttaattttataactggacctcatttttctcttctgtaaaacaatgtggagaatttcaggacctgagaaatgactcgaataggataagaactaagatagatttaattcaagtaaaagtcattaagcattatgcatatggctatatgcaccagtactatggagattccaaagtgtccaagaccaagagaaacactaaggacccactgagagaggcagcttatgaccacaaccacaaagcagaactaagtctctgtgatcaggctgggcgtggtggctcatacctgtaatcccagcactttgggaggccaaggcgggtggatcacctgaggtgaagggtttgagaccagcctgaccaacatggagaaacctcatctctactaaaaatacaaaattagccgggtgtggtggcgcatgcctgtaatgccagctactcaggaggctgaggcaggagaattgcttgaatccaggaggcagaggttgcgataagccgagattgcgccattgcactccagaagcctgggcaacaagagcgaaactccgtctcataaaaaaaaaaaaaaaaaaaaaaagactccgtgatccaaggaggaagtggaagtgcagagaggtagcaccaaccaggaaaaatgggaaaggcttaccaggagagtgaacttggattaacagcgaggattttgacagaagtagagagaagctctttggtttaggggaaccacttagcccagcctcatccgacatgggcatgaaatatctgacatgtttaagaaaaagggagaaatttggtgtggctgcagtggaggatttcagagagagcacagcaacatacgaggatggggatgaaagctgggctcagatcaacaaggtccttgagtcttgctaacaaggttggattttcatttttagagatttcagagtaattgaaaatttctaagaaatttttaaaaatcttaaataacaccaatcacagaaaacttggtgatgaaaataaaaggctttattgggaatccaaatacccacattgggattcttattcaaccatttactggacgtaaacgtcaacctctctggaatttgttttatatttttctgtgggtaattaaatgaaatgttaggggaatagaaaagtaaatgagataatggatgtgaaagcactttgccaacaataacatactgcaaaaaaagaatgcatccacacactcgattttgcattgcaaactctgctaaaatggaataagaacaaaatctgttatcacaggggcagcctcctccttaagacacaaaagtccaatttataattttattttaagaaacttttggagatgcttctgtcagatgaatcataagccattgaagataagttgttcattttcagccttccattccaattgttttgaaaacatctgtgtcatcattctacatgtcatggacaccaaaatggtaaactgtcatggcacaggctaaacagaagccatcactctctgaagcctcttatttgtatcttaagttacatggttattatgaaatctactttggtaaattggaatttaaaaaacaaataaaagtaaaccattacacacagagttctggagttgtactgttaatgtactctgtatgtggagtgggagtgggggtataagcagtgggagggagggaggaaggctgacatttaaaaaaaatatttccatgaaacaggattctgacctagtagagttcccctgttgccaggaaaatattgagtagatatttaaatcaggcaaaggggcactgcatcgccaaagacaaactgtgcctttgtgaaacaaaatgcctcacacaggcaaacatcttctttcagaggcccctctagagaaatgaataaagtaagattaaataaaagccaaactggtgataatgaaagtcctgaatgttatttttcttaaataatatcaacgtaaaatattggcttcccaaaagaaaaaaattactcttggttatgaaaaaaacatcaaaaaataaaaactaaaatgtacctctaagccatatcacaagcctagtgaggtgtttgtttataaatccaggccctgggcaagtcagccaatctgctgtccaagacactcataagcctgcaaaaataagatttaacatcttgcatcctcaggaggacagaagttacatttataaagcaggcccaatagagagaactggcttaaatttgagcaatgattcactccatcacaaatggaaatttgatctcaaataaagagcctacctcaagactgtttctgagccttttaaatttctaacttatatgtagagttcatttattgttttggtattgatttctaattttattgcacgttggccagtgaatagagtctgtatgaaattaacattttattttattttatttttttgagatagtgtctcgctctgtcacctaggctggagagcagtggcatgatctgggctcactgcaacctctgcctcccaggttcaactgcctcagcctcccgaataggtgggattacaggcacccaccaccatcgtggctaatttttgtatttttaatagagatggggtttcaccatgttgtccaggctgatctggaactcctgaccttaggtgatccacccacctcggcctcccaaagtgctgggattgcaggcgtgagccaccatgcccagctgaaattagctttttaaaaagttccggtttgttactcttttggcggcctagtgcatggtcagtttttataaatgttccttgattgcttaagaaatgcatattctctaatttgggagtacagagttctagaaaaaaaactcttggtaaggtgtatttaattttaatgtcactgacctatcaattactgagaaatgcaaattaaaatatctcactaaattggacttgactatttctttttgcagttcattacatatttcaaggctatgttattaggtacatgtaagtttatcattattatatatttgtcatgaatttagccttttttcactatgtaatgaccctcaattatctccagttatgctttctgcctgaaagtatatttagtctgctttctatttctatttttgtcagctttttaaaaattcaattttcactagcgtatcttattctgtcaactctcaatctttgtttgtgcaagatttttttgtaaacaacccataactgattgtggagtattttttagtctagtctatcactctctgtctttaatggcaaatttggtctatctacacttattatcactgatctatctgatttttaccatcttattttgtgctttatgttaaactttcttagtccattctctatttctccttgccaagtgtctaatcagattgatctacttttcttcattcacttttttttctttgtttctgtattggttttgctctttgacattctagttctctttcctgttaatctttaaacaaaatctaagtttaattaccagtaatttagaaagcttatacttgaatcatccatctctgattttacatgacaatgttccctcatatttttactccactgaattttctactccctacttagggaggctgtggttgtcattttacagccatttctttctagatctaccctcaccttaatcaatttcattgctcccatttccttcctgtatctcactcccttcttctaggatccattttttaaattaaatcttttgttattatctgaagtgaggttcaattagcaacaaactctctttttaactccttcttttatgttcttccttaatatttaaaaagtttatttattttatactctttatccaatactttaattatttaaccttctgcttaatcatgttcattgtttctgttaaatcttggttgggggagatctctcttcagctatttttttgtaatttgcgggtggcagagtcatctttagcgggtctctatctgcaggaattctgtacagcgtaggttgaagacatgtctctccatgaagatttcgtatttacttctgccaggtttcccagattatcactagcccatgaccatttttctgtattaatttctcagccttagagttcctggcacacactgttgtgtgtatggggtggggactcgggtaatgacaggctcagttccaattctctgctttgtggaagctcaagatttcattccttgcccctagttgacctttaaaacccaaatctctgcattatagcaacctaggacaaccaggtgtcaacataagaatgtgctgctctgctctattctcacttttttccttattttagtccctaaggagttcattgcctttcttcccagttcagctgtgcatttaaaaggatgttaaactccatgcagcaattccaggtgttttgcaaaaggaatgtttctcaggtccttttatagtaacctctctattttactagaaccaagagccctctctgcatactttttacctatttactttgaatagttttcatttttaatgcagccatcatcctaactcatgttatgctttacttcattcatttattaattaatcaattgtcaaaaattacttatatgaattgtataatcctctatgaaagattcaaaaatggcaagaaagagtgcctgtcctctacttgtttgagaatctacaattctgtgtattttatttaaaaatacatgactaaattatttttgttaggctctaaacatagctttgtcattctgacacactgatttatttctctggatgaaaccattctcaagtaatcatcttgtttttggataatgatcgttattgttctttgttttcttttgttgttgttgcctcctgttattccatgacaacattgtgtgtgctcatcatgttttagaaatgcaatggcttgttccacataaaggtttctccctgcctgggttttctttctttgtcttctctttaaatgttgctatccccagagtttcatccttggtctacccctctcctctctccatatgtatctttgggcattcttatttgctctcatgtttgaactataacatgcatgctgtattattttcctagggctgccgtaaccaagtaccacaaaatgtgtggcttagaaacaacagaaattcatcgtctcatagttctggaggatcaaagtctgaaatcaaggtatcagcaaggccttgctccatccgagactgtggataaaatctgtccttggctcttctagcttctggtgctgtccagcaattgaatgttccattgcttgcagttgcatcagtccaacctctgcctgtcttcacatggagttctccctctgtgtttccatatcatcttccctctgtgtgtgtctatgtccaaatttctcctttgtgtaaggacaccagtcattttattaggctcaccctaatgacctcatcttaacttgattaaatctgcaaaacctctatttccacataaggtcacattctaaggaactgggggttaggacttcagcatatcttgtgagggaggcacaattttttaacctgtaacaggcagctgtttctgccagtctatatcttgagtccccagggcactctcacagatgccagacccaaatataaacagaagaactgcactttttatcccaggtactgtttaagcatgtcacacatattgctatatttaatccatatagcaccacatgaagtaggaattattatcatccatattttggtgatgaaaaacctgagaaacagcaagattaagtagcttcccagatcccacagttagtacatggcagagtttagaactcaagtgctgtgactcccgatcaaggactttccatcctgagctctaggcccaccacactgcctgacaggtgtcccagaagcatcttaaacacaggatgaaccaaactgaaatcacctattttaaacattttttttttgtatattcattaacacctacccagctgctcatgctaaatctaagctgtcttcaattccattcttctctttgactttcaagaaaaacagataacatcattagcactgtagaaatgtaaaaattagccctgggcaacacagtagattattttacaaaattccctctccacctcctttgtttacttaagtcttatttgaaaaggctgttgcagaatgtctacaacaatttaacaaacacattctctcatcccattcctgtgttctcccctgggtatttttgtcagcacagcttaggaagaagaacccagactgtggagtcagaaagaactgggttcgaatcctggctcttcaaatgattggctgtgacatatttggcaactctcttagcgttcctagttttagtttctttactgtcgagtgagaatgataatgagtacctacatcatagggtggtcgcatgatttaaatgagataatgccttttctacaaagtgcatgtccaagtgcctgacaacagtgcatatcaatagatagtagctgtcgttgctttttagaaaaatgacttgattttagcctcacatttaacccaatggtggtttcctcaaccgctattcagctgataactttaaaatacacataataaactttgatgttagcatttctattttagtgggttttgttatttagttgtttgagcatagcaggaatttaaacagaagattaaagaagcatgtcccatcatatcgacagagtggaagagatcctcgggtgtgttcagggacgtaacaaagaaagatgaagacacaagtcatttcaccagcaggttctgggcctgagaataggctctggtctcacccagttgtgcaagtgttcccgggaaagtcatttcacctctctcagtcttggttttctcatgtttaaaggaagactgaacttagaccaccaagaatcctgcaacccctgcgagtctgcgattcctgctagttagatctagattactgttaacttgataaatcacatttactctcctccacacagaatccaagtgctggctgtgttgtctggcgattgagaacacaaaagacatgatcatcacctcactaaacttacaatctaatagaacagacaggcttataaataactcacgctaagaggattggaaacataatatatcagccatcagggcttggtcggagggtatgttctattacttgttattcactggctttcaaagcccagtgggggaatgtcaatatttagggaggatcatgtggaaactatgcagtcctctaacactctgagaactcaagatcccttctttacatgaaatcagactgccaaagactcatgctgggtgtctgtcctctacctgtgctgagctattctctaatgtaactcagcgctcacagaagatgtcacaagaaataagctgttgaaatgcagtgctgcaactgtggcaggaagacggtcgatggtcaggtctatggccccagtggccccaaaagggatccttcttttaggattctacactatgataaacattgccttccctgtgaaacttcttttttgaaaggaaaaattatttccccaaataactcttttcattttggctgccaggaagctcaaagccatactagaaacttaagtacagcatcttgggcaagcttgtggtcaaaatggctgcattcttccctcacatgctcttggcttctcatttgtatttttaactgccttagcactgattcctaatttccatttgataagtcaattgggtataagcccatcagtagtttagttcacacggcacctcaaatcctttgcagaatatccacatttaagtaagtatatacatgcatttgagaatacaatatgaaacaaaataaagtatgataacaaaataattggtaagatgtcataagaggagtgattaatttgccagaggatcaagcatggctcccttgacagggcagattttgaagatgtctggaagaatgagcaagagcattccagagagggaaccgcagggacaaggacaccgggtggtgaaaatgcagcgcgtgagttggggatgtggcagaggaaaacggcagaggctgcaaagggctttcgaaatcacatcatcgtgggtataaatgaagctgttcttgattcgtcctgtcatagcaatctccattcctcacatgctctgaaatactggtctgagtcattcatttgagctctcaatcacaccttctcctgtctgtcaaaaactacttaccccacatgggtgggtcttagctacttctgacagccttcggtcatctcctcagtgattaagagtaatgggaactccatgaacactttctaacggaatagaaaggtcctagcacaggggtctgagtaagacacaagtcatgtagcttcagccacacatgtttggtgggcaagaaaaggtgattttaaatctcattagagcttttattcacggtgaatggaacacagtaagagtttaatgaatgaattaataatgaagaaagtgaagagatacagtgaagagaagaatgtggctactcttatctctgagattactgattattgcaagggtctatgctgaaagtgaattattttaaaaatagaagcagaggcatttgaaaaactcaacactttagcacctattttaaggaattaaaacagaaaaagaggccaggcccggtggctcacgcctgtaatcccagcactttgggtgaccgaggtgggtggatcatctgaggtcaggagtttgagaccagccttgccaacatggtgaaaccccgtctctactacaaatacaaaaattagctggctgtggtggcaggcgcctgagatcccagctactcaggaggctgaggcaggagaattgcttgaacccaggagacagaggttgcagtaagccgtgaccgcgccattgcactccagcctgggcaacagagcgaggctccatctcaaaataaataaataaataaaaaataataataaaaaaacagaaaaagagaaatctttcaaaatgctataagctgctaaagcgagaggtcctattgcattttggtcagcattttgcaacttttaagaagtgaatggagcctgtgccttcctctttgttagccacttggttagcacatctccatgttcacagccaacacctaaagagtaacagtaactactgcaatgagtgattcttcatttttttttggaatgttaatgtgatactgttaatcatttctatctttcctttttgtctacttgccttttctaaaagtgataaaccatatctttattaaaaataattcaagtctattaaagtaaaatttatatcttctatctagattagaacttttcaaccttattgtacatgaaaattacatacacaataagcatgttaataatgtaaaatttccaaccccacacccaggtttggaacatttggaagtgtgtgtgtgtgtgtgtgtgtgtgtgtgtgtctgggaaagggtctcactctggcttcctggtgggagtgaagtggtgcaatcatggttcactgcagcctcaaacttctgggctcaaagaatcctcccgcctcagtctcccaagtagctgggactacaggaaccaccactacacctggctaatgttaaaattttttgtagaaatggggtcccactatgttgtccaggctggtcttgaactccttggcctcccaaagtgctgggattacaggtgtaagccactgtgactggcaggaaatgtgtatttttaatcataaattttccaggtaatcttgatacaagtggttctgaccatactttgaaaaacactttctaggccaggcgtggtggttcatgcctgtaatcccagcactttgggaggccgaggtgggcggatcacctgaggtcaggagtttgagaccagcctggcaaacatggcgaaaccccatctctactaaaaatacaaaaattagcctggcgtggtggcgggcgcctgtaatcccagctactcaggaggctgaggcaggagaatcacttgaacctgggaggcagaggttgcagtgagctgagatcctgccattgcaattcagtctggggaacaagagcgagactttgtctcaaaaaaaaaaaaaaaaaaaaaaagaaagaaagaaaaagaaaaacactttctagtcaacctccaaattaagctcggccaaaaaagagccatgtaaccagcatgggggatgtcacacttgtcaggcccctcttattacaactggtttcactgaatgacacttgggtttacgacagtgtaagagactgccctgccctatgagagatcctcctagatttacagatactcgcaccaaatacatagataaaaaccagagatgggaattatggcctaaccagtaccctttgggaaggcacaatcaacagtcttgccagaacaacaggcacaaaccagggctgcccagaatgcctggtggcgctactggttgaatgctttgctcatgactccccttatcttccttaggacaaacagaggaacacatcttcctccagactcagaattaatagctggaccatcttttcacatttgctttctttttatcctgtaggcactgaattatccctttcatactgcctgatgatacctcgaagccaaataacacctaccttttgcaattctgcaatatttaaatgttgcaattaaaaatacacatacacacacacacacgtgcgtgtaaacctcactcctggttttactctctctgttcaatttttactttagtccattctccacattcctttatttttaaaaagtggattctaccgtgctctttcatatgtatctatgtgagctttcttaaatctgttctgaaataggaggcagtgtaaatatatcaagtgacagtctacatttatccttcagggacattttctagttgacactttcttatgggcttttttttgacactttttttatgggcttctttattaactcaagatcatgagtatcaaaaccagggttgagggaatcgcttctcaaaagtgggttccaggtaccagaacccaatctgaacacggacaaagccccccagctcctctgtggttttatctctcagtctccgtacagtacaaatttcctcatcagtgtttattagggccactgctatctctagtgtgtaaacatcggcatgtattgatgatggtacaaatgtttaggaataactgatggtttttttttttttcactcagctatccgtgtgatttgcattagtgccaagcaatgtctctaagtagtaaggtctatgtgaaccactcaggaccaggtctggagaattctttttgcacacatggggtactccgtgccccaaatctgccttagtgaggtgcctggataccatggggatggatacagcagctggtacagctgcctgaggtcctgcaacctcatggccacattggaaaattgtccagattgtgcaatgaagctgtgtgtgtgtgtgcgtgtgtgtgtgtgtgtgttcatctctgtgtgtgtatgagcacacatacatgaagcttgaccaataactgaaagactcacaacttgcaaaatcagccacaactagctctcttacaaacactattaactgaataactgcctacactggcgtgaagcaactgaaggagggaagagctgaagagaagagtactttgctccaaagaaaggaaacagccttcacatcaaagcttactataagccaatttgcagagctatccttgcatccatccagctaatatttgatgagcagctactatgtataaaaaatcctgggtgctctgacttcagttgattctctgttctcttccccacacaaatatctctcttattttctaaatactttccttagtgtagaaagactcaagtctggccctactgaaaaggatatttatgacatcaaagcatattgatggcctcatggaaatacagcctcaccagttagaagatggtaccaggcattacctcttacatctgtgattcaatgaggaaccaagcaaggaatcttcagtgcaggccccctcagatggattctctcatctttgagatctaaacactttgttttgtctcctttgaagaaattacattcttaaggaggagggcaaagggtgagatgggttagggggcttcctttgggtgtctacttcactttgttcatgcccagagagtgtctgggcaacacaccactgccctcctgcctctcctccaggcacatcctagccttcgagtttttcttatgtgccacacatctggagtgggcacctgggacatttgtgtttctatttttcccatccaacaggaacagccccctgttctgaggcacagcagcaagtgaggcagtctcaggcattcaggtgcattgtcaagatcaaaccaaatgcatggcctctgtacctgtcaactgcctttcagtaaatactaaggacggttttctccctttcgtaatctaccatcagtgtctcctgtaagtcttaaaaaatgctttgaaatcaggcacaaccccaaaggatggtccctttcacaccccactgcatcgaaccagctttacgtgtttgctgaaagtcacatggtgacagatctaagctgaaacctgggattcaaatccaggccagatgttttgcaaagtaccctgcactcctgaactcttctgtctagaaggtgacagaagcccactgggcatgatccaactcaggtaaagggaaagtcacaccatggagggaatctaacctgtttgccatcacacttcgcagatattaatttaggtgaccccaggagcaagggagaattgagtttgtgcagatttcacccatgcatgcccttggctactttgccaacaaggagtaacttgtacagtgcagctcagtggtgaggtgtccgttcatccattctccacctcccttaatattcactgagcacctcccacttaccaggcactgcaactggccctggagatagggcctttgtggggcttatgttccattcagggaagaggataataagaaaactttttatttttttatttttattattttgagacggagtcttgctcttgtcgcccaggctggagtgcaatggcacaattttggctcactgcaacctctgcctctctggttcaagcgattctcctgcctcagcctcccaaagtgctgggattacaggtgtgagccaccatggctggccagtaagaaaacttttacataaacatgcaatataatggcagaagggaatgaatgaaatcaagaaaaatcaggccaacaggagactggcagtcacaggtggagacgagagcaattccagacggaagtgctcaggactggcctccctgaggccatgacattggcacggatacttggtgaaggaaaatgatatggaactacctggaattaagggtttcaggctgagctgacgccaaattcaaatccctgaggcaggaccgcagggtgaccagatggctgaaacaagtaacaggagggaacccacagaaattgctgtaagcagctgagatttaatccaatgccaacaggcagagactaaaggagtaaggcagacctgcctgagtcctaacttggcctcttattagcctaatgcccttggaaaagttggtggacctctctgaacttcatcttcctcatcagggaaatcatgagaaagatgtccatttgcaaagattgcttgagatcacgtttctaaagcatttatccaaatgcctcctgtagggtaaaggttcactgactggtgactgttgctgttgttcttatatttctggctttaggtagcatgtatcctctgaggagctttaagtcattttttctattacctttagtttggctaaataaataagttcttgtcacgtctttcaagttcaagagctattcctttgggttggttttgaattatgtttgtggtaaagagttactctggttattagaatctgtattacaggccagtgatagctggaattttagatgcttaagggaacacgtaagacagccatataatatatggctcccacatgtttatttttccagataagagaattttaaaaacaaacaagtctatcatctatcataaatagtacctcatgaaggacaggatatttggaacaataatctccaagaagtggcaattcctccctagaaaggtcacctttcatagacatatacacacgtgtgcatatgtgtgtgcacacaagcaaggctgcatgtttgcctggacatcctctttctctctgtctctctccatacgtagtgtgtgtgtgtgtgtgtgtgtgtgtgtgtgtgtgtgtgtatttttctctatgtggcaaaataaagagctggggctacatactgctgtctcacatattttttaaatatttgtatttttaaatacaggtgtatttttcttgctttgctgtcgatccgtgaacatgtcctcatgcatagacctctgccagctcccatttacaagccctgctctggacaaaggagatgtgatcaatgccacaggtgggggagaagagctccctgaggctcagcctagccttggggaagttgcgatctgccgagggcagtgaagctgtgggcacctgacctgctggcacgataactctgcgctcgttcgtggtcatgtttgggggtggcatgtgcttctcctccatgtagctgccgtagttcatcccaacggtgtctgggctgcccaccatcttcccgcctttggccacactgcattcatcaggagagttcctggaggagaagaaatattcttccattataacagcaatcaaagagcatgtctccatcgacttctcacaatacacagagagaaccaaagaagggcaaggcggaagagactgggggagaaaggacaagtgtgaaaagccaaatacaggcggggtgccgtggctcatgcctgtagtcccaacactttgggatgccgaggtgggcggatcatgaggtcaagagatccagaccatcctggccaacatggtgaaaccccgtctctactaaaaatacaaaaattagctgggcatgcctgtagtcccagctactcaggaggctgaggcaggaaaattgcttgaatccgggaggtggaggttgcagtgagctgagatcatgccactgcactccagactggcgacagagtaagattccatctcaaaacaaaaaagaaaagaaaagaaaagaaatgccgaaaacaggccttgccttctgtcctcccgaaatgcatattttgaagccctaactcccaatgtgatgatattaggagagagagcctttgggaggtaatttcagtttgatgaggtcatgagggtagagtcccacgatgggattagtgcccttattagaaaagaaagagaccagagctcgagctctctctctctctctctctctctctctctctctctctgccatgtaagggcagagcaagaaggtggccaggccatctgcaacccaaggacagagacctcaccagagactggccctgctggtgtctgattttagacttccaacctccagaagtatgcaagctcgagtcccattgtttcagccagccagtctgtggggctctgtgaaggcagcctgcacaggctaggacagtgcccatactggctagatgcacagaacacgcacaagggaggcggaactaccacctggcttctgtttcttaagcagctcctcctgaaactgtcatgtcaaaactccatctgtgacaactgattggggacacttgcagggaacagtgaactgctctttgttctcgcggtgtgacagcaaacaggcagagtagacagatgctgtggggcggcaccagggacactcgctgctcagtgaggtttatcctggaacgacgttccttctcaaaacctcagaatgaaatcctcctgctcaatttcaaatccctgcagccaatctttacatatggagctttgaagactcacagtgttccaggcttaggtgtagacaggaagggcagggaagggtgaggactgacgctaggggaggcctcatggggagtggactccagcagtcctagaggacccttgggaaagggatagggaaggaactgtgtggatgcagagaggggtcagctactgactactgaccgtgggcaacaggtcacagggctgctgttagtaaggcagtcactgtcatttggataaagtcaaacctacctttctggaaaaagaaaaggaaaacattttaaacagtgagttgtgaaagctacaggacattggtgaaatcgcatctgatagggaaatgctaaaaagaaaatccagcttagggccaggagtggtggctcacacctgtaatcccagcattttgggaggccgaggtgggcagatcacctgaggtcaggagttcaagaccagcctgatcaacatggagaaacccagtctttactaaaaatacaaaattagctgggcaagtggtggtgcatgcctttaatctcagctactcgggaggctgaggcaggagaatcccttgaacctgggaggttgaggtcgtggtgagctgagatggcgccattgcactccagcctgggcaacatgagtgaaactccatcaaaaaaagaagaaaggaaagaaagaaagaaagagagagagaaagagagagaaagaaaagagagagaaaatccagcttaagcagaaaacagaaaatacatgtcagtgccttcttagatggttaacacgtagatggtaaacccagggtcactgtagctgagaagtattaatatttagggtctgttgtctaaggcggatttccagaaatgcctctcaggctctatccaatgcatacatttttttcatattccttggaatctgggaaccttcgctttctctagattttagatttctatcccagtgtttctggttgtgggatccacgccaatgaagcctcatttatctcctccacttcttgttagttggagttctgcagagaacttggacaatcaaaaaactatgggcttggcatggatgtgaacttcaagtctaaggaggtcaaaaccatctgaggcaggagcgcactttctgagtggggtgagatggagaaggtcattccacacctgaaagccatagctgggatgtggacaggaagggaaagtgtttgttcagcatgtgggaacttgaaaatataggtttgttctcagcatcacttacaaatgtgtctgaagcctatggagggatcttaggtgttggcagtgaagagggtacactgccatctgcggatggaggttacagtcagggtcacgcaggactcaggccctaacatgggcctggaatgcacagccctgcctgatggcatcctcacagctgtgctaacatgaaggaaattttaaaataataatggtctgagttcccatgaagtagatcctgaatatttccaccgctgcctacacatgcattatttcctcttgatgctatttttcctggcttcacacatttatctctaaaagacccatcctaatatgaaaacacagagtgtcttcacttagactgagtttcctattcctctggaaaattccatcagttgagtagagtgtatatgttttggtatatttgtctcaaggagagaagttaccagggaagagaagttagagggattaggttctttaggaaaaagactttgcccagatgatgtgagtaactcaagtaacaactataaaatctagacaacctttgttcagattcaatcattcactcatccatttagacagctgttatcaagtgccggccgtataccaggtcccatcaattctttcttctccaacaacgcagttaacaatttgaaaagtaaaagatcaaagagatgtataaaattatagaaacaggccaggtgtggtgactcacgcctgtaatcccagcactttgggaggccgagctgggcggatcacctgaggtcgggagtttgagaccagcctgaccaacatggaaaaaccctgtctctacttaaaaaaaaaaattagccgggcgtggtggtgcatgcccgtaatcccagctactcgggaggctgaggcaggagaatcgcttgaaccagggaggcggaggttgcggtgagccaagaccacgccattgcaccccagcctgggcaacaagagcaagactccatgtcaaaaaaaaaaagaattatagaaacaggggacattgaggattttgaacccttcagaccaacccctttttcattttcttttagttctttctagtttaattttcatatccgaggacaagaactctaggcatagatcacaagagtttctctgtgacattaaagtagatccttcaggctggttgcggcagctcatgcctgtaatctcagcactttgggaggctgaggcaggcagatcacttgaggctaagtgttcgagaccagcctggcctcccaagtagctggcattacaggcgcctgccaccacgcctggctgatttttgtatttttagtagagacggggtttcaccatgttggccaggctggtctcgaactcctgacctaaggtgatccttctgccttggcttcccaaggtgctgggattacaggcgtgagccacttcacccaggtttctcttgcaaattttaacagcaaaagagtagccttaacatgtttgggatctgttttgggagcttaatagttatcagtcttcaccacagcgaactgtgttgctggcattgtctccactttccagaggtgtgaactgagtactcaaaacacaaggggctggctccaggactcacagccaggaggaggtagaatgagacttcagtgcgggtggcccgaactctccatccctgcttcttaaccctgaacagaatgactccacaaagtaaaggcaagacaatgtcttttcaaaggtaactagatcttcatttcaggaaggcatcagggactccctgacccatacactactctggtttaaggtgtacactaaagcactcatcctgacatactctcctaccctgggactgttcattccctgaaaagcatgtgcatgacacaaacagggcacatatacaagatgcaaataagaaagaggagtgattcctggagaagaaaagaattttcagagatatctgctttacttaagaaaaggacgccaggcacagtggctcacgcatataatcccagcattttgggaggccaagataggtgaattgttttagctcaggagttcaagaccagcctggacaacatgaaaaatgtgtttacaaaaaatacaaaaattagtcgggcatggtgtgcacctgtagtcccagctactcaggaggctcaggtgggaggatcacctgagcctggggaggttgagactgcagtgagctgagatcatgctactgcactgcagcctggacaacagagcaaaaccgtgtctcaaaaaaaaaacaaaagagagaaaaaaagaaaaggaaattttatcacaattcagagaactgaaaagtgttcatttgaaagtctcactataaatacatttctagctctgtgcccaagaaaagatccacactgcacaaatgtgtgtcttgattactccactgcaaccccaccttcaccaggcattccgaggctcacacatcgccgggaaaaagttcccgcaaacagcttggtatgtcacctgcaccaagcgctgcccagcatagaggaccacgtgttctccattctcacatgataaggatttggacgttcaatgcattgttttattgtgcacatgacaaagagtatgctgtgcagggaatgaacagtcctgaagtaggacagtgtgtcaggatgagtgctgcaatgtacactttaaaccagagtagtgtatgggtcagggagtccctgatgccttcctgaaatgaagactagttaccttttaaacatacacatacttttaaacatacacatacttgcatatgtgtgttgcagcagttcctgagaatattctcaggctattcagcaggtgcctgtcaaacagataatcatttagtaaatattaaatgtatctgtctttttgtttggggtggaaatttctttattgcaaataagcgtggttcaagatattgctctcacagactcctttgaggacaaacaaaaatcattttgtctttttatttaatttaaatagttttgggggaacaggtggtgtctggttacacgaataagttctttagtggtgatttctgagattttgttgcacccatcacccaagcagtaaacactgtacccagtgtgcaatcttttctccctcacccactcccatgcttcccccagagtccccaaagtccactgtatcattcttatgcttttgtgtcctcatagcttagcttctagttataagtgagaacacacaatatttggttttccattcctgagttacttcggttagaataatggtctccaactccatccaagttgctgcaaatgccattttcttccttttcatgggtgcatagtattccatggtgtgtgtgtgtatatacacacacgcatatatacacatatacccacacatatacatatgtatatatgtacatatacacatatatgtatatctacatatgcacacatatacatatataatatgtacacatatacatatatatgtacacatatacacatgtacatacgcacatataaacatgtgtgtatacatgtatacacgtgtacacatgtacatatacacatatgtgtatatacatgtatgcacatgtacatatatacatatgtgtatatacatgtatgcacatgtacatatatacatatgtgtatatgtacatgtatacacatgtacatatatacatatgtgtatatgtacatgtatacacatgtacatatatacatatgtgtatatatacatgtatacacatgtacatatatacatatatgtgtatatatgtatatatgtgtgtatacatgtatatgtgtgtgcatatatgtctatatatatgtgtgtatatatatatacacacacacacacacaccacattttctttatccactcattggttgatgggcatttaggctggttccacatttttgcaattgcgaattgtgctgctataaacatgcatgcgcaagtgtctttttcatttcctctgggtagataaccagtggtgggattgctggatcaaatggtagttttacttctaattttccatactgttttccacagtggttgtactagttccatagtggttgtactagtttccatgctgttttccatagtggttgtactagtttacattcccattggcagtgtaaaagtgttcccttttcaccatatccatgccaacatctattttttttttatttttaatgatggccattcttgcaggagtaaaatggtatcaccctgtggtcttgatttgcatttccctgataacaagtgatgttgagtgttttttcatgtttgttggccatttgtatttcttcttttgagaattgtctattcatgtccttaacccattttttgatgaaattatttatttttttcttgctgatttgtttgagttgtcgattctggatattagtcctttgtcaaatgcatagtttgcaaatattttcttccactctgtgggttgtctgtttgctgattatttcttttgctgtgaagaaagtttttggtttaactaagtcccatctatttatctttgtttttgttgcatttgcttttggattcttggtcatgaactgttattctcaaatttacattttcagttccaggttctatttgtcacccacagacattagtcttgacagtcctatgcaatatgtggcatcaacaagagtaaacaggagctgggaagacagatacttccctctgctcacagcagcagaaattccacattagccagggggccccaagaggtggggggctggttcagaattctgagaaagaactgaacaatagcccaatggctgggatattaaaaagccagccataacacctcacaactccctagcaacacccttggggccacacagcctcaaactcctgagctcaagcaatcctccttggttcagcctccctatgaatagctgggactacaggccacactccttgaggagtgtaacctctgcagcaatctcacacttttccatggcatttggtcataactgtggtcactcacaggaacacagaaatagtgtaggaagacaaccaaacattcatgatggaaataaaaaaaaccagaatgctggtgtccttcttctagtaactggagacgtgcccaatgaaactggcttgttgagcttcaaacaataatctcccttaaacagcagttggagaattaagttctaatcatttaaaatcatgagcactgacttcttaaaacatactagtattctgaattaatgagaaaaggacacggcaaagaatatcaaatacattggaaattttgttaaatttgagttaaggagagaaggcagacacgttgctaagcccagttgggttctcatagggttactgaatcagagggctggaagaagccccattttcaagcccccagacatgactgtctggaaaccacttggatgaacaagagtttagcttcgttaacagttttttagggaggggcttcgtaattttcctctgcaactccagagttctatttataaatatgtatagtggttttaaatagccattattcccctacctgtgtgcaagctatgtgaagtttggggtggcttataaaaatacatataagacaaaatgataacataaataattaacagaataaaaatgaggaaacaagggccaaaaaggaattaagagatgaaagcagcccactgagtaagcttactatttatcctgctgaggtaggataccaattcaactctgagctttctactagccaaagcaaagacacaagtgcatctgatgacaaggtttgaggtattaataagctacatacaaaccagttattcagcagaaataaagctctccctgggttaagctttgagagtttttctcggggcttctcatgaagaaaactggattatgcagtaaacaatatcgttcccaacatctcataatacatctaagaccatcccgcaccgtgccaggcgtagctggtggcagagcaggacgctccctgcacacagtgctcacatgctgcagccacagaggatgagagacggcatgtccccagcctctcctccttactggctgccattggaaagatcagacctgtcagagaagtcaatgcaaaaacatgaaaaaaacgtgtaattaaaaaaggagaaaaccttgagagatgcagtgttatacatgcctctagtttcataactcccaaatttctagatttgatttgattttattgttttttaagagacagggtcttgctctgtcacccaggctggagtacagaggtatgattatagctcactgcagtctcaaactcctgggctcaagcgatcctcttgcctcagcctcccaagtagttgggactacaggcacgtgccaccacacccagctgttttttaattatttgtatagatggggtctcactatgttgcccaggctggcctctaactcctgtcctcaagcaatcctcccacctcagcctccccaagaactgggattgcaggcatgagctgctgcactgaaacccctaatttctagattttaaattcaaatttaccaacactaaatagggtcatgtttatgtctcccaagagcaccaaatgcactgtgggtaaacaactctttccaggcctcagttggttaatcttccaaccagtatttcactgttgactaatgatgagcatggctccagactctttccacgtgtttatgttataataaacatatggataaagcatttaacatggtgcctggcacatgaccacgccaggtgtcagctattgctgttagttcatttcatctgcacatctccatgacagaaatactcgaaagcaggagccttgttacagatgaagcacagagaggttggataacttgcccaagatcacacagccagtagtggaagaattgggatttgaacctagatagtcatggtctcgactccaagtacttcaccgccccactctatgcccttgcttggtaaatccgtgtgaggagtctttcatagacctaaagcaccattgaatggatcctcagaaaacttaatttcatcactattaagtattctaaaagaacatcttcagagtggccctgaagacagtcatggatgagggttacagacgtgagctgagcagggcagccacgaaggagcaaggcagggccccgtgggagacttggaaggtggcaatgtttatgtagagatataaataggttttgataagtttggtctaaaagaaatagtcatctcaatttgcagttaagcgttctatgcttctccccaaaacttcattgctgtgcccagcagggtgcatgttttacacagatgatgggcaaacattcttaagtgcaaaaggaaaccagacaaaaagtccccatgacgagacagccgagtgggagtgcatctgactctgactgcaggcccaaaaagatggaggtgaggaccaggacaggagctggaccactggggaagcagtcaatctaattttttaagattaaataaaataagtccaagatgaaagcctccttgagctgtcgtccatacataataccccttaaacaaaaaaaaagcggggttggtggtggggactaatattactgaaaaaacatactgagaaatgtaaaatttggtctttagtctttgaaaaacaaaataaacttggcatctgactttggttttctcacatcagagtctacttacagcgaggcaatttccgtcatggaaagaacccgcaatgaaatggcacagccgtggccattagcttgacaagcatggagcctcagcccttgtgagtgtgaatgggcctcatttatccaagaacggcactgaatacatcccagaggggcagccccaagctcgctggccacattaaatctgattcaccctcacttcagaacacttagcaggggcccactccttggagaaagtccaaggcaagtcagaatgtaattgcggaaatcaatatgtcttcttctttgagtcagtggaggcaaacccgctaatcctgtcgaaaatctacctattcttctagagccatcctccttcctaatcctctgaattcctcttgcacctggacacgactttccaaccccttgttctccatcacatgctggtgaaatgtccccgaactcttccaaagctttctccctcctgctaccagagtgctctcccccaaacagaaatgcaagctgcccatgtccaacctaacccccatcatggcccagagcccctccctagattctcctcagtgatctggctctggagcccctcaattcactcatttgtttagcaaatatctgtggagcatctttctaggccaagcactgccccaggtactggagttatatcagtgtctctattaacatggggctggcatttgagtagccaaagcccctctccccaactccatgtgctctgtgctcaaagaccacattccacatcaccccctagtctcttcccttcaggccttcacttttgctactccctctgccttcaaggcctatgaccacctgatacctgccctattcacctgttcaccacctggtacctgctctattcacctgtccatgctcacctctaggttctctacaagcctttcctgggccgccagagaggaatgtctcccttccaattgcaccattctctgtattttctcagtaagtgtctgcaggatgagtgagtacatttatgaatgaatcttccatttaaatattgagttccttatctcatacctgcagtgcaagagaaagcccctcgtgttgcagtcagaaaaccattgctgaccttggttgaccttagatgggtcacctaacctttcgaggctcaactccttcattcataaaaatgaatggatgctttcttgaggttgctgtgaggacatccctgagatgatgcctgtgaagaaagtctgcaaactgtgaagcactatacagattaacacagcaacatactgcatgtgcatggctgtgcatgcgtgtatgtgggtgtaaatgtgaggctttttgttcttggcaactgttcataactgtacctcggtgaactcttaggtaggtcaggaagctaaggtttactattgtgcagtgttcagcatgcaactgctttttggaatgtcactgtctttctgaatgttccttttggtttattaggttagttcacattaagaagaacttggtgaggaagccacatggaagaaatggaaaggctttctttggcagctctaccctaagagggcaaaggggtcagttctgcgagagaacccccacaaggaggctggcccgggacaagcattccaggcctgtctcaagtctgaatacaaataaatcccttctcaggtggttttcttcataaggatcctaaaagcatatacttagtcctaatcgactgagcaagctcctaatcaagtttcatagtgtgaatcggaggtcagtcaccacaaaaggtatttttaggaccccagacaaggaggggattgtctggagcgctgcagggtaatttgtgggtctgttttatttctgaatcagaggcagtggaaaagctgtttcagaccccatggctggagcagcgggtggagctcagcagtgattcatgtagaactccgggctcaaactgaaaccgtagatgtttgtcttcacagctgtgtgttatttttacccttactaaatattctctcttacacctggaatttcagcctcttcccaacagtcctgttccctcccccttccctgaagcagttgaagacaaaattaattaaaaagtcaccaccagctcaccaacagttagttctttgtccccttaaaggggctcgatgtttccctgagaaagtttcattatttaagtttatatttctctttacagccaaaaacgaatgccagcaagaccgtgttgcttttagatcttgaaaactggagggaaatgcaccattttgggattcatcatttgaaaacaaaatgttctgtagcataagatctctacaagcagttacatgacaaagatcagatgtgacatcttttctatcttgtgcacgtcttttaatttgtctgaaagactcctttttcagagaagaaaggattgagcccaatagccagtatggtgcttcatgtttttataacaggccaggtgaatcctggtaaccaaaacaattttactttctttttttcttttttttttttttttgagacggagttttgctcttgttgcctaggctggagtgcaatggcgcgatctcagctcactgcaacctccgcccccactgggttcaagcgattctcccgcctcagcctccgggattataggcacctggctaattttttttttaatatatatttttagtagagatggggtttcaccatgttggccaggctggtctcgaactcctgacccacctattatttttaaaatgtgattgttttggaaacacctggtgaggttaatgtaaaggtgagtgcaggtgaactgacctgatgtgataaagtaagatagtaataaatgtttctaaaatgtgtaacatatacaaaaaatcaaaatgcagttggcacttggatttggtgcatcttgtcactgcttgtctgacacgtggagagaaccttgctatccctctcaatgcaggaaagacgttcagcttcttctaagaagccctgagggagtgaagaagagtccaggcctgtggtcaaatggccaactttcactttcactaactttcacttgagcaagtgacgaaaacttttggaaactcagtggtcatccgtaaatgtgaataatcataataatgtcatctcatagatgtttgagaaaactggacaatatgttgtataccaaaatctattaataaatcatgtgggttttagaaatatgggttaatattatccctttcagggtctttttctcctgcccaggtagagttgatggtaccctcatatctgttattgctgggccctgaacatcgctctgtactgaatgtgtcttatgatctcacagaatctttttcacctttggtagaccatgagctcctcttagttccttttttttttctttctctcttttttttttttgagacagagtcttgctctgtcactggagtgcagtgccgtgatctcagctcattgcaacctctgcctcccaggttcaagtgattctcctgtctcagcctcctgagtagctgggactacaggcacctgccaccatgcccagctaacttctgtattttttgtagagatgggggtttcaccatgttggccaggctggtcttgaactcctgacctcaagtgatctgcccacctcagcctcccaaagtgctgggattacaagtgtgagccacctgcacccggccagcttcacttaattcttaatccatctccatcgaagctaacacagtccatgatgcagattaaacactaaatacacgttggtttcctgcagcatttgtcaacttcgacactagtgccactcggagccaggtcactctttggacaggtgggggtgggggctgcaggggcgctgccctgtgtactgcaggatgtccccggcctctacccaccagacaccagtaacacctcccagctgtgaccagcagaaacacgagcattggcaaatgcctctgggggccacatcacgatggttgagaaccactgggctaatgaattaagatccactgagctcaggcaaggaggcaagagcctcttgttttacctggtgtttattagagagaagttcctgtccccagtgtctggggtgatgcttaaaaggggcccttaaaggggcctctatgctcatgaggattcctagttatggtttgtccgtaccttgtttggggtacattccccaagccttggcccatcctcgcttcctcttttcctcatgccatatgtccaacccatcagcaaagcacgttaattccaccttccaactatacccaggatgcgactgcctctcccaccctcccttgctaccactctcacccactctcacgcagatgtctcccatcctacacccacattttctcaggaagacttcaacacaggagccagagaggccctgcaaaatctaagtaacactatatccctcctttgcctcaagtcccctaatgatttctgaactcaccagaaagtgaaagtcaaagtccggcaatggccccacgggctctccaaactcatcatctattactcttcttcttggacactaaacagcagccacgatggcctgcttgttgtcctcgaacacctcaagctgacctcagggcctttgcatttagcattccctcctcttggaatattttctgctgtttaatcacgggcattctccctcaactgcctttgcagctttactcaaacatcacttttttgtgatcttctccagccaccttctttagagctgccatccgcttcacgtctttatttttctccttagcatttaccatgatctaacctgctgtgttttcataagtggtctgatgtcatgaccatcttcactgctagaaagtgaacttagtgaggcaaaacttttttgtatattttatcactctatcccaagagactaggaaagtaggtgctcaataaatattcattgaatgaatgaatgactccacgcataaacagtatgtctaaggccctgatggacccagcagatactccctactttttctcatctccatcacatgacaaatggcatgttttttaaataacatctataaaacatcctgctatctgacccgaggctggagttattcatggcatgcaatgaatctatcccagagagaggcaaggcccagatagcattgtctctcgctgcacaggcccagctgggcaaagcgccaatgtggcgggagggaaggaggtatttctcaactcaggcaaggacttctggggaacaaccccacctccgcgtagatcctcccagatcattcgctgggtgggtcacctttacccagctgctgggctttctcatttttcatctccttggatcgtgcaacagagcagtggttctcagactaccaggcatcggaatcccgcagagggctccttcaaacacagcgtgctgggctgccacccaggtctcttccgattctagggcagggcctaagaagccgcatctcaaacaagctcccaggtggaggtgatgctgctggtcccggagcccacgctgagaatcaccacaccgggggaaccctcactcaacagaatcaaacatggcaatggctccaggtggcctgcagactgggctgaggggggactcacagcatggcacataaattgactgagttccacctgcagtgagcctccaggtgggcttcacgaaatcgccatcgcctgtggaaaggggaaggtgccacttagtgtaagctgcctgtgatctggctggcctgagctggggatgctcagatggaggaaaagcagcctgctctgcacagacctgccagcctgctcacgagaagacagtttgcttgtggaccatgagtgagcaggtgttacctcttggcttatcctgctagtctatcatgacttgagctttggggacctcacagcaaattcagggcattggtagggagctcacgagaggctgagcaggcgctgaaactcccagccaggcccttggtgtggatggcacaggaaaacagctggttttagtttggccacacactgacagttctccattgtgtgaacacttggggctttctggtgcgtgaggctagagtgaagaaagggagagggtggctgtggaccaccgaagctgaaaaatgatgtcctgtgtctacacaacgtgcaattagattactgtctgcaagaatgctgctgtttgatctggcagtggccaagccaaacccacaaggacatcccagttggctcgcaaagcagtggttcctttctctcctgtttttcttttattatgctttacagaaactctattataatggcaacagatctcgtttcaccacttgtatttcatttcaggagcttgtaagcacgttaggactgaggttttgtagaattccactattcggttgggaactaagtccttcctttctctcaaagcacatggcctttttctccgtgggtactggatggatagggatggacagagggcactattcccaagctgggtattctaggcagaaggaggtgggccatgttctggaaagacctaagctgcagagagtgcacttctcccgtggaggtgtctgcaagatagtcaggggccacaaaggtaacagcccacaagttctagccaaagagtaatatttgacttacgtaacttccccttggacttgacttcaagtggcatgtgcactacaggaaagcccattatgcataagctaagaggagggacaattagaagaagctattgggccaggggccaggagatgggctaactccctggcacagctggcctggggcttccgagtctggaaggatgcaggtgcaggtagtggagcgttgaggagctgcactcctggcggggctcctccagaggcaggcagccacacactgctctgcagcatctcatctgtgagcccctccgtggcagaatctgcgtctccgtgaaccctgcctctgccctggcccctcgagctgggctgacacagcccggtgctggttcacggtgtccaaaataaagcagagtgaatcacgcccatgttcccttttatggagctgcacctgacattcgtaaagagcccatagtgaggccgggcatggtggctcacgcttgtaatcccagcactttgggaggctgaggcgggtggatcacctgaggtaaggagttcgagaccagcctggacaacatggtgaagccccatctccgctaaaaatatgaaaactagccactcgggaggctgaggcaggagaatcgcttgaactcgggaggcagaggttgcagtgagccgagattgtgccattgcattccagcctgggtgacaagagcaaaactgtctcaaaaaaaaaaaaaaaaaaaaaaaaaagcccacagtgagtcagcaaagcctgcggatgggatcccaggcagtcctttgtctgccccaaggctgcctccaacctctggctgagatgagtcttagctccactgataactgttcagctttcttttcccccattccccttcaggaagcccgttggattgttaatagcagaacactgactcaccacttatgtttcaattctttcagatcactgagcttgagcagccccctagtgaacctctgacctgacacgccaccccctttaccacccgctgtccagtcaggctgagctccagcagcagcggtgaactggccccccagagcacactggtttggagatctaaaaagtacaatgggtcaccagtcactgatgagtgcagcatccctggaagtcaggtgtgggggtcagtttcctgtgtcaacttggccaggccgtagcacccagtgacttaatcaaatgctaactgaggttgtactgggaaggcatttgcacaggtagctagtcagttgaacttgactaaaggagatgatgtcagataatgtgagtgggccttgtctaatcagttgaaggccttaagaacaaagcctgcggtttccagagcagaagaaattctgcctactttccagcctgccagcctcccctgcagatctcagacctgcccactcccacaactgcattagccaattccttcaaataaatatcttaaaatgtaaaaatatcctataagttctatttctctagagaatcccaactgatacaccaggccagcacccagacacaatgccaggagacacactgagctctgggggagacgggcatgagctctgtatctttctcttctacaaaggggattagtgtcagccactcctctccctccccctggaacatccttgtgggtaggggacgatgacacttggtgactggttgacatctgtacattgctagatgcctcaaagcggaggcagcctctgcagccagtgttcctcccctgcctattacaacccagctgcccttttcctcaaaggaggcacgtaggcctggattgaaggcagatgaggtccaccttgttcccttcatgaacagcacctgccaaaccgacatcaccgaacccaccggaggacccggaggatgaagaggatgacatgatggtcttcactcggtatccacccaccaaaacacatcaccgatgctttaggagctggaacagcattgaaagtttatgacggcagcaatctgggcaatgttagaattctatgagccctgagagaggaactcttaaagttcccattgtttccttgaaagaaaatgtcaaggccgggcgcggtggctaacacctgtaatcccagcaatctgagaggccaagatgggtggattgagttcgagaccagcctggccaacatggtgaaaccccatctctactaaaaatacaaaatttagccaggcatggtggcggatgcctgtaatcccagctactcaggaggctgaggcaggggagtcgcttgaaccccggggggtggaggttgcagtaagctgagatcgtgccacttccctgcagcctgggtaaaaaagagcaaaactccatctaaaagaaaaataaaaaagaaagaaaatgtccagttcccctgaaaaagatgtttcccggaaagagaccctcagcgcagcaccagcctttcacttgcctgacagaaaaaccacccaagagctttccccagtctgctgcgctgagggccctggggcggaactgccctggtgtctttcttatggactgaagctcctggtgtctttctttcttatagactgtagccccttgcctggggctcagggttaccccaaactcccaacctgtacccctggggtcacaacacaggctggaaaagcttccccatgcctggccaggagggagaggagacatcagctaccaaggggcatcacaggctcacactaaggaaaacagtgtttgcacttctcccacaaacagaatgcttatttttttattttttatttttatttttttgagatggagtttctctctgtcgcccaggctggagtgcagtggcgcgatctcggctcactgcaagctccgcctcccgggttcatgccattctcctgcctcagcctcccgagtagctgggactacaggtgcccaccaccacgcccggctaattttttgtatttttagtagagacagggtttcaccatgttagccaggatggtctcgatctcttgacctcgtgatccacccgccttggcctcccagagtgctgggattacaggcgtgagccactgcgcccggccagaatgcttattttattttaaattcgggagtaacacagtgagaacaatagaaactttcatttctggagcactgttctcgcctcctcactcagtctcccttcggaggcttgctgaatccagactggccccaggccagactctcaaacaagggccaggacatggctcactctgcctgttgtccatcggaaatcatctcagtgcccttttgtctgagatgtttccttcctctctccccaccttccaacatccccctcctccctgcaggtgaattgctcataggtagaaattagcctctgcagaagaaaagctttagaaatgtgtcccggtcttagtgtctccgccgtgatcacgctggcatatatgggatcatatgaccccacccaaaacagaattcattcagtgtttccaggctgtgttccaccaactgatctactgcataaacactgctgcattctttagaacatgattaccctgcattcttctgtgtttcagaaatatatatagttaatgatcaacagaaacattgtatcaaatgcataggatttatgggtaaaaaatatttacatgtaatcattaatttcccacaactttggtgtcctggacccatcattgcattttctatccaggtccttctgtaactccaggaatgaatctcttgatgagattcaaaaatatttacatgtaatcattaatttcccacaactttggtgtcctggacccatcattgcattttctacccaggtccttctgtaactccaggaatgaatctcctgatgagattcaagatgggcctgcctcgagttccacttaaaggaccagtgcggtggcaatatgtagcatcagagccagtgcactttcaagaagcagatgcacagacgcaaactgacttctcagagtggaggagtgttctggcatctcccatctccccatctggcacgtccagccttgccgttgacattccctctaggacactgtgacttggcaccttcattaacaccacactaggaattgacgcaaccgtttccagacttataaactatgacacttataataaacctttttagcgttaaaacatatatgtaacaaaaaggccccattacagcttcaacagagtggaaaatgctcagggtgtggagtcaaacactcctggtttaaatccaaactctgattccatttaagtggtgatttggggtcagactggaaatgcctgatcacaggtttcttcatccatcaaatggggtcaagtatacttcatgaggggctgctcggaggactgaggggctactggatataaaagggctttgtacacagtaaagtttccgaaaatgtgagctgttcttatgacctgatggtagattatgcaacatttcgaagaaataatctgttctttatcctaagatttgatattctttttcctgaatatatatggggtattagatcataattgaaattaattttacttttcaaaactacacagaattcaacactttttgagggccagggacagttctgcatttggtaatacattttacgtgacagttgtatgttcatgacaaactcagggaagctaataattatgggagacactggagagggctttatgtgtaagctaagaggaggaaaaaaaaaaaaaacaaacagcaggcattaagagaagaggaccgcagagatcagagggtggggtgagggtggagggcagacaatggagatccactagcaaattcaagtggcttggacatacgccgcactgcctggccactagctgacactctccctttgtgaaaacataagacggcattattttccaggcaatcaaacctcagatgaattctgccatatgtgggcaaggctcccctcccacagagccctcgtgcctgggaaatagaattgaacacatcttcaaagagagttcttggtaaatatactactaattttacaaactccatcctctacacaaaccactggagaacacattttcccagcgctgtccaacgtcaccgttcaatggcctttctttctttctttcttcttctttttttttttttttttttgttagccagagtcttgctctgtcgcccaggctggagtgcagtggcatgatcccggctcactgcaacctctgcctcctggattcaagtgattctcctgcctcaggctcccgagtagctgggattacaggcacagtggccttgctttctaagtcaatctttagagaagcatgactgacttccactttgcctttgcaaaggataggaaaatgggaggtcagggagagaaaggggcggaagtctccttaccttgagccattcacctggctagggttacattccattttgatggtgaccctggctgggggttgagacagccaatcctgctgagggacgcgtgggctcatcttggaagtctgtccatagtcgctggaggaggacgcggtcatctctgtcttagccaggtgtggcgttccgtaggcacactcaaacaacgactggtcctcactcacaactgataaggcttcctgaatgcccaaagaaacacataattcaagacactccaacagacagtcatgtttcaaaaagttgttgatttcagagtcctttctaactgggaccacattttagatcgtttttatggtctccatttctacctttcagaagaaaaaagtagcttgtttttctttcctcgggacagtaagagttagaaatgccagcctagaaaaacttttatgcaggtctcgaagcatcccaggcttgactgtggcagggcagcagaatatccactttaatctcaacttaaggaagttgaatttcaaaggtcttagaagacatccaattgcatgtgtcactatttgacaaatgcaatctataattcaagcagacagggtacagagcggtcatgaggattaaaaaaaagaaatctgaaggccaacacctaagcatctggcaaaattgccacattcctggggattttgcggaagagggacttagaggaagacagagggatcaatggagcaccaaagggcaaccaaccaaagatacaaacgtttccactctaagttattagccgaagtacagtttcaagtggtgcttccatgatggtgagcatctggatgataaatgaaccaaaaaaaaaaaaaaaaaaaaaaaaaaagctgtgaagtatccagatgcttccaaacagcaggatgtttaaaatatctggatcactgacaagctcttttttccccttactttcaattaatatcttcgctcttttgcatgatttggtgagaagaaatagcaatttgtcattgttggatcaatcatttttcgtggttttaagtcaaacaagtggttagccaatggctatgtttatattctacagccaatgagcaacggcaagtttgggaaatttcaacgacttaaatgatggcttgtgctgcaatgacacagagctgttgtgatacaatccaattttggttcttataacagacaaaaagaattccacatgaatgctcatttttatattagtcctttggcatcctcagtattgacatcaactagtgagaagcaaaggctagttgggccacacatttttatttaaaaaaaaagaaaaagaaaagaactttggaggcagagcaggggaggcaggggagtgtgggctgcgcagacccttccagtccaaacttgtcatctccaaatgagaaatctgagacccagaaaggtctagagctaatcttgaatgagctggccatgatcaaccaggggattagtgatgggaatgacttgtgtattaccatctgccttctccttgcccccacagccctatgatgccctttgtgacatttttttcctttgggacatgtgtttaaattagcaccctcttccccttctctgagatgacctttacataaataagggtgcttcccatcagtaatcacaccctagaagcagcccttctgagatggagagcttcctctccacccagaaggatcagaatttttaggaaacaatcacccccaactccacatctactctgtcgctcgatcctccacctgtcccaggaccaagttttttccttagcttcccaagtgcacaaacttctttgccagacacacggcactgagaatcagcaaggaggaagaatcaaaacaaactcaaacctctgtctctcaaagtggtggtcaggtgtctgtgctaaagcaaaagcccccatcctggactccataagtatctgtagaattacagccctgtgacaccctgggaaagactaagcctgctgtccaaacagtaatgcaaaatgtaccaaagagtcaggtaggccagacagagaaccagaatcaggcacaagggaaaaaagtcatcttgaatagacagcaaaatcaaactcatcaacaaccaaaaatgatacgaggcagtgacacagaagttgacagtacagaaacggcatcctagatgttagggaacctgaaattcatggctttctcttccagtcacaattgagtggccaaaacaaggaatctaaacacatagatgtgggtttcaaagtaaaatcagcaccatagacttagtcatgctaattaagacaaaaattagaccttattaaaaaatttttgcaaaacagatactcccttcccatggtggcactggctagtgtgttttacaggctcagaacaggaaacagagctgatggctgctgcctctctccttcctgggcctgagactcgaccaaggctcgcaggggaataacacactatgtaatgttagctttggctcacccatgatgagaaacatgaacaaatgtgtgatttatatcagaaattggcgaaaacaggttatatatataagaaacaggctaaatttaaaattacaaactaaaaaggaaatggctgcaacaataacaaacaagcaataactttaaagtattagtatttctccaagataaagtaagcttacttctgcaaacaaagccaatagccacaaaaatgtagtgtaagtttgaataataaaaaaaagaccaaaatattagaactaaaatgaagcttaagtgtgtgtttgtaggggaaggaatccattctcacatctggcaaagcattatttcagcacatggttttctaaagaaagaaatcaaagttaattgagatcgatttaggaaggaaaaaaccctcagaaatgctagagatgggggaggcatgcctcctttttttgcatcttaaaattcttctcacagctaatattgcacaaaaatgaggaagggaatataattcagaatattgaaagcaacccctcagttgcttttgttcattagaagggaaaaattctgaaaataaggaagcttcaggataaacacttcaaaagaggtgaaatacagtccacattttgaaaagacagagcaacccaaactatgccccaaagactttgttgattgtcactcaacaaaggctgctgaacacctaggatgaagtacagctcaggaaaaggaaacaaatgaataaagaaaatctctctcacatacacattttgggagtaagaagaagctgaggggttttcacagacccattcccacaacagcggtcactaaagttaagtgctgctcttcagaagcaaaccaaggcacagccctgccacatctttgtcctcccacttgacttggctgttggcaggtttcatcatcccttcggttaaagcttgaatggacacacgctgctgcatagggccctccctgcctggcagccctgtgacttcaaaggggagagaggatctagcccagtaggattaaaaccagaaaaagagtgctgaacacaggctgctaatcaggaccacatgagttctttaactccagctctgggagagacttcctggccttgactgacatgtctctccttccctgcagcctggctcctcctctttataactagcagatctcacctacctacttacctgcctgcctacctgccggccaaggtaggcagctgccttagttagcatgtatagattgttattgcagaaactctggccagccacaaggcttgggatctgcttcagtggctttataacagagaatattttaaacgtcaaaatctggcagatatgtggcataatcatttcatatgcctgcttctatgttactataaaaagacctgaactttagattggtgtttgccaatgtgtggggtgtttttttctgtagctccaggaaagttgggatattcccatcaggcaaatggcaggctaccaagctcatttttaaataacttacgagaaacacataattctaagcaaattacccccaaacaaaaggtactactgtgttagtactgtagtattgattatttcatttcaatacggaatataccaataacacatgaggaccattcctttggattttggtcatgggataacagttccagaaatgaagggaggtcccaccaggttatatttcatattataactctaaaatatgcatctattttcaagtaactagagtacaaaaaaggatccaaaatacattagaacactgaaaaagaaaactaacaaagttgaatgcatactgacattttcagcaaagtatttcaggaatcctgatgcctttctataacagatgaatactttgcaagatgcctatttctcaaccaaagtattagaaaataaaggcccaaaattgattctaatttgtgatccttatagctcataaaaatattacattgttaatacagagaatccatcatacttaacctcttttgaaaatttgggagtggtaaagtgttgaaactgagaaaatctttaagaatggtcaggtgaatttcacatctggagtaagcaaaggcatccatggtcctttcgtggttttcaaaaattaggaagatggccagaactaggcctctcgagaattggattatcaaacccaccttcaatgttttcaagtcttatatgctataattatttgataattatgaaaaacaaatggaacaactaagtggaacaagaattgtatgatcatgatcatgcttaaaaaaaaaaaaatcttggttcgggcatggtggctcacccctgtaatccaagcactttgagaggccaaggtgggtgggtcatgagttcaggagatcgagaccatacaaaaatccaaaaaaaaaacaaagaaaaaaaaatagccaggcgtgatggtgggcgcctgtagtcccagctactcaagagggtgaggcaggagaattgcttgaacccgggaagcggaggttgcagtgagccgggatcacgcgactgcactccagccgaggtgacagagtgagactccatctcaaaaaaataaaataaaataagaaataaaaaataaaaaaatcttaaagaagtccttgctgctatcacaacacagtgtggagatcattcacttaggaagccagcatcatcttcaatcaatagcctactttttctgtcagttttaatcccattacaatccaatacaaaacccttccttaaatttccctcacatataaccacgcagaatttggtacatcacttaactccctatattgccatcttttaaccactttcataaatagcttatccaccaaataaaccaggttaccttaagcactttcatgcaatatcctcttaaattctattttgttgattacaagatacaccacttgtcacattttatcagctctgaaatatgaaaatgaaaggcttatcctaggtatcaggcagcatttcttcttctctgatggcagataaaataatgggacattttatatccaatgacatcttacattttatgaaaaatgatcatttaatccttacaattgtcctataaggtcagctgtgattcttgcccacccatcagaaagtgcgattagagaagtaacatcaacagtgaggatgaggcagaaacagggtttgtgtctgtgaatggaatcattccccaaggctgtagactggccactacctggctgttactggaaggaagaagttggattaagaaaagtcacacggtggagtgttttggtgcctgctcttgccatgagagatggaatcacctagagagagacagagagagagaggctggtagagggaagagacagaagaaagatgaagggataagtgtccagaatccctggatctgggatggaataaaggatctggatggtaaacggagagtgctgggaaccagtaaggacttctctaggtataccatgctcttctatgagcctaggggatgtgtagcaatgggccctgcatacagttaatcatttcttttgcaatggcttaaatcaacaaccttgttcttttctttgattaatcagattattcagacacaaagacatggccaggtgttgggatgtgttcattgcaggtggatgcctgccttctcttaatgagtactatgcaggaaaactaggacaggtaggagtaccatttataaatatgctggagcctatgccactttgggcggcctttagtggatgtctgcagacctaaggatattggaaatctatctattaggctgtcgcaggctctattgtttatagtttctcttcaaggcagcacatatgcagtagatgcttctaaaaggtctagtatctaattgtatttggaggaggaaaaaacaacacaaacaaaatagacaatgcacttagagaaagctctgctctcccaccataagcctgacaaagatactccagtccttcaggagtttttattctaaatgtgtgcacttttgcaattctgatgccaccagtatctcattaaacaagaatcttcatctgaccagtgtgtcttttatttacaacacacaaaaaagcgaaacgtggtaagtgaaagaagcttcacaaagctgggtatgatcatttttgccccttcttgatatgattttcttttcttcttaattcttcagagaaggaagtattaacatcgtatattaaatgcagcatctagctttgtgttcacgtttttctaatttaacacattgcaattttagtccttcaaaactataaaaaaaatcttggattaacctcaaaggaaaaatgtatgtaggcaaatgaagtccatctaaagagagtatttctccaatatggtatcacttcagtgtcaaataatttcaccactcacaacactagtccagtgctaagaaatgagacccagaactagtgtccagatacatttgcacatacagatatacaaacacatacacatgcttacatatgtacacatatacatgtgtgcatgcatgcaaatacatacatgcgcaaatacatatatacatacacacacatatatacagatacgcacatgcatatacacaaatacatatataagtgtatgcatatatgcaaatagatacctacagaaatacatgcagatatacaatacataatgtatatacaaaaatatcatacatatgtatacatattactaaatacatactaagataataaggagagatgaaaatctttatccttattatctttattaatagaacgctttagaggactttcagatattctttatctttaatcatatccactagggcaaatgttgcctaaaagatacagagaacctggcttcttcccatttcacctctgctccttcctctctcatcctagaaggtgcttttccctatgctcagcacatcccttcagaacagacttagctggggatccatcccctccatgtccttcagccaattttcccggctctggactcacagactttctcagggctctgagaaggcctggctggtgccagcaattctctttgcccacatacttctcccctggccttgcctttattcaaatataagcattttcagggctggctcctctgtatgtctgcctctagaaataagataatttcttaacctcaaatgcttgttggtgttcatattagccctaggactaagacatcaggtgatattacagccccatcataatgctataaatgggatccacaaacttctattacatccaaatgaagagacgtgtttttgtgagatgaatggattgtgtagccaacgcccaggagttccagggagtttggaaaataattgccattggcaatatgtctgcagtcatactaccaaagagcgtattattgcagagtttcaccttcaatccacataggcttaaatagggacttcctatagctaagcaacctatgaacaaaataagacttactggaaaatgaacgtttgcaaaagaaggagggagcattcaatctggaaagcagaaactctagaaatattgtgaaagattggagcatggtagaaaaatgttaaagaaagaatagttatgtccacataatgaaaattagatttaaatgagccttgggagatcaagaatgtcaaccaacatcattttaaaacaactctgttttctcagtgccatgcagaataaacctcgaatgcatttgaaaggacaatgaactgggactctttgccctggcaaatgccatttaactgtttaagaaacaacatgcctgtgatgtgaatagcttcttattttcttctttaaagaatcgcttttttggctgggtgcagtggctcactccagtaatcccagcattttggcaggccgaggcaggtggatcacctgaggtcaggagttggagagcaggctggccaacatgatgaaaccctgtctctactaaaaatacaaaaagttagctgggtgtggtggtgtgcacctgcaatctcagctactcaggaggctgagacaagagaatcgcttgaacccgggagggggaggctgcagtgagctgagatcgcgccacggcactctagcctgggcaacaagagaaaaactccatcaaaaaaaaaaaaaaaagaagaagaagaatcactttttcttcccagtaggcttctttccttctttggagatgagcaaaaagtataaaaacatctgtggaaacctcctgtttgtatgttttacattggaatgggtgcaaaaaatacactcactattcctttacatccttctaagagggctgtttctactcttgacactcaatacttgtttttgtttctctaatcactgttatacgttactcacgaatattcatcaaaacccttttccttattttttatctagttttaaataattcatttgagataaaaagaagtttttctttgctttttttaatcactcagtggaggatgaacatgaagctgtaccaatggataggagaccgtctggtagagcacgggagccagggatagggatctgaagatggaagatgtgagtttcaagctgggctctgcccttgctctgggaatcacctgggtaaatcctttaaccctttcctgccccaagtgtgagctgagagcttgccagaaatgcagattccgagtctccagccctgctgagtcagaatctgctttgtaacaacttccccaggtgagctgggtgcctgctcacttcaacaagtgctgcattatccttttttgactctcaatttcttcaactataaaggtggtactgatggcaaccagctgccgagcagctctctcccaggacagttaaatgggccaaataatctagtgtgtgtaacaggtttcataaatcttaatattgtatttaaattatcatatgatagaagggtgatgtgactgactccaaacctctgcatgtgaaccatcagaattatccattctagtcatattattctaacaagccagatgcaaggaaaatcacagtctcttgtgtgcaaattatcacttattttttgtaagtactggattttcaaaccaagtatctacctaacagaggggaagggagatctagcatcttttacttcaagagcacgtctgtcactttgatttatagcctttttggtccctggtccagttcttttgtgggttttccattcaaattctacattagtttgtttaatgtcaattaaatcaaagctttgtgcaggaaggaatgaatcctggtacactccccagcgtgctgttggtattctctacataacaagataataaattaatagatataccatggtcttataacataatgttctttttctttctttctttctttctttctttttttttttttttacctagaatagcacaaggcacaaagttgatagccctcaaacttctgaagaaaagtcttttcttccaggatgtggaatccataatgctttctatgttaactttccctaaaaattgttgaatttttcataaacttctatgaggaagtgtttccatggcagtctggctaagaggttcacaccatcattctgtcctggtgatttttgaaacttacaagcccaggttgaaactcaggtgattcaaggcttgagaaacacaaaggccaagctcaaggagtagcaaagttgcttgcactttttttctattggcatggtccttctctgaacaccagggaaggggtggtgcaccacctctctcctcttcagaaggagctccgtgaaaaatcggcagttttatgcttggccctttcaaaacacacaaaggctaaaaatacagtgtgctacgcatctggaatgtgtctcatctgtgaatctctgacacatggattcattgttttcgataaaattccaggaattttattcatgagaaaattctggcacaatggaaaaccctggcaagcaaaagataggggcagcagatgtcctggcctccacccacaactctgtctctgcttttagctaattttcatcaggtgtcactctcatgccttcaaacactcaattcaaaatttcccataagacgggggtgagggggtgggggtgtcaaaacagccttaattttttaaataattggtacggtcccccccctccccacagacaggtgtgtcacaccaggttcaacatgcacgtgccaggatgcaggatgggcactttaagaagaagccgcaagaccacagggccactggccatggggctccaccactccgtgcccctcatgtaccaagtcttcaagctcctcgtctaaaatgagggtctggtctactgatgttttctaagactccattttgcaccaaaatgagatcgatttgtttaactagtaacatcctctttcagccatagccaggctgcagtctctacctcctccatctctgagcagacatgcagataaggtagaaatctaccatgtatggagttgctaaaaagttcctatgcatccaggttagatgctaactgcagggtctttccctgctgcccccagactttaattttcctcaatcttgtaggtatctccttctgtgctaatggtaagaagctagtcagcaccctgagagctagtgttatgtttttaagtgtggaaaggatctactctcttgcatgggaatatggcatctgttctacacataaagcacttcaataataataataaataaaaaaatttaaaaaataaaaaacacatggcaacatggtaataccaacagaaagtcttgtagaaactggggttctggcagacagaggagcacatgaataagtctccactattcacatgatggtccaggggtctccttcttttgctttctatccccatccccatcattgttggcatgggccacacactgtataacgcagacatgaacacagacgttttctttttcttagacgctgacttacgtagaaagagttagtcttcacccactgtgagggtccaatccctgccaaggtctttcttcagcttggtaagtgatgatgtctgactccctggggctgggatgctaagcctgtgcttttcagaagatttttccagcacataaatatatcctggttgctgcatggaaaggggactaagtagccaggtcatcagagccctttgctaatgttatacgctgagctcatgcttttcctatgacatagatgagcactgggtagaccccgtcctggtaacacttttcatgcactaacaagttggttgccagtgagacttgatttttatgactctgggagtgctgacctcaaaacctaatacatttgaactaggagagcaatccctccaacaatttcaaactacacatacttacatcacatccaatagggctcttttgccatctggcttgagcccctctataaatatgtctactttgaaagtcacaagcctgggcggggtggctcacacctgtaatcccagcactttgggaggtggaggcaggcagaccacgaggtcaggagatggaaaacatcctggctaacatggtgaaaccccatctctactaaaaatacaaaaaattagctgggcgtggtggcacatgcctgtagtcccagctactcaggaggctgaggcaggagaatcgcttgaacctgggggacagaggttgcagtgagccgagatcatgccactgcactctggcctgggcgaaagagcaagactctgtctcaaaaaaaaaaaaaaaagtcacaaatactctttgaaagtgtgcagagtcattcatatccaaaccatcaaggcctgcccaacagcctggtgacttgaaatcttgacgtgtacacagagtctaaacctcggtctttagattgcctccttactggacctctttacttattaagattcatccttgtggaggaagtgaggtcatggatgttcacatctatctttcccaggaagaaaaggaagcttcaagagctgggaaatgctatgcaccactgtgcaggttctgagcagcacagagccacctgtggggtgggcgggtaggtgagtagtggacatctgaccaccaggcgctgtgcaggactacctccttgcagagcaggtggggccttccaagttgcctactcatccaacctgcacagtaagccttatgggagcgtcatggggctacgcctacttcaaagagcaacttagctaaagggaaagagaatttgcacttgctctcttccactctagcagacttgcacttgtcgctatttatttgtgaacacagactcattttagattgacttaaaaataaaaaaaagtgcaaagaacagggcagctggaagttgggaaaccacttctgccactgctgaatctgaagccttaagctcctgaactggaaaaccagccgactggagcactgagctccctgggccctgtaaaagagcacactggccaggcatggtggctcgtgcctgtaatcccagcacttttggaggccaagacgggcagatcacgaggtcaggagttcgagaccagcctggccaacatggtgaaactctgtctctactaaaaatacaaatattagccaggtgtggtggcgtgtgcctgtaatcccagctactcggtaggccgaggctggagaatagcttgaacctgggaggtggaggttgcagtgagctgaggttgcgccactgcactccagcctgggtgacagagtgagactctggctcaaaaaaaaaaaaaaaaaaaagaatgcaccaagtagtggccagtcaggctcccatgggccttgacacgtgagatgtcaggcagaatttttattaatgaatctgatgccaattcagtatttctgcaatcacaatgcactttcgcaatatttatccaagcaatatttatccaacaaaaatatccaatatttatttatccaggatctcgcaaacgttcagtctagtttcactcacgtcagtgtctctaaccttcatactttgctttcaagcaagagtcgtgtgttggtctgggtgtccgaaggtgggggtggtagctggtgatgcaaggaaccaaaaattggccatacttacttacttaaatatttcacagctctttaacagattctcatctcctgctctcttctcttctccaaccttgccgtctggttctgacactgtcctgccacgattaggagtgagctttttggggttccctcaaacattcactcccagctggtctctttgttacctactcaagagcagttcatactgttggccactctccccttttttaaccctcttttctttggcttccatattcctgctattcctcctatttggttgacaattccatcccccatctctttatgccctcctttttctctcctcattctctaaatgtcagctttcctctgtgcactctcctgggccacttctctactaggctatcatttcttccaagccatcactcaggagccactccaatggcctcagcgctgccaggaagcgcagcgcatttaatttgaagggtgaaactgccttggagggatggcaggtgcatgcttaataacttgtttcccaaggccacataagtgtcattactggatgataattatcagctcaagagggaaagttctaagacagagaatgcaagatttctaaacaggtctaagacagttttccaatgtaagatttattatgtaacagttttgaaagtagtgtctgattccctgtctatatcctccagaacaatctgagggcatggttgccattacaatttactttgggggacgattttatagcacgtcttcacagacaacacgacaaacatctttgcttctgctacactgacaacctgaagttaacatttctgtacctatgtagccattttaatcaccccctaaactggttattccacagcccaggggtgtgggactgagtcagatgggctagagatacctttattcagaggatttagaagtttgcctcagagaaaggccatttctagtctccactagaaatcacacatatcttccaggaataagaatattctcttagtcataagttcaacaaatatgtactgaacaccttttctacttagaaacttgtctagctgcttctagattacatccatgacccaaaaccacaaagacacctatctgcataaggcttgtattctagcactacaagccacagataatttttgaaaatcaattaatcaaccaataattgatagggtaaatttataaccttgtttttcaagcctgatctcagggttagaaggtggtaagtgataagtatgaagaaacagaaggcagaactagagactcaggaaaagagaggtaaactgctgcttttcatttagagtggccagggtggtcctgagaaaacgcgaaggaggggagggtgtgagcccccatgcattcatgaagaataggccttccagccttggcaacagctagaacaaggccagagtggactgcgggggctgcacgaggaacaatgggaccaagaacagccagggaggaggggttactggaaaggagcgaaagaaagaaccaggaggtgaaccaggaaaggctgggggtggtagagccttgcaggccatggcaggaacctgggtgttgactcagagagaagtggagtctctctagccgtcttggctaaaagcccgggaattgtcttcttctgtgttgcactaatattttccatctcataagggttctgcaaagaaaattctttctatctttaaagttttattattttcaaaactaaatgtgatgagaatgcatatattgcatatgccatgtgtacaccaaaagccacacctaataaaatgttacagccatcctttgtcccacatgcaacgggaacttccattcatcatcacatgcagaaactctgggaactgagaatctgtacttttcattcagagtctgcaaggggtcacggccattttgaaaggctttgactcacacaggaaatacctcactgaggctcccacccacccatccactaatagggcagcctttagggaaactgacttgtggcaactgaaaggaataacggcaccaaagtattcccctgccctgaaatctctgtttacctgtggaccggtgatgggtgtgaggctgtaggttttaacgagctctgaatggcaaatggcagacaatggtgtcacttcctttctgcttaggaaggagacgtttggaaaaactgttcactgctgtgcttgcctatggagaacctggattcccagagctctatctggtagaacgtgtctccatattaataagcagtgaatcctcttttgcggctgaattttcctcaaggaagcagcatgggccttattactgccttaaaacccaatttcaatattcgatacatagtctgtgtattcatttgctagggttgccaagacaatgtaccacggactgaggggcttaagcaacagacatttattctctcatggctctggaagctggaagtcagagagcaaagtagcagcggggttgattcctcctgaggactccctccttagcttgtggatggtcatcttctccctgtctcttcatatcatcctccctctatgcatgcctgtttctgagtccaaattacctctttttataaggacatcagtcccactgaattaaggaccaccctaagggcctcattttaattggattacctctgtaaaggccctacctccaaataaggtcccactctgaggtcctgggggttaggacttcaacataactcagggaacactattcaacccataccatcctccaggaaggcagagaatgtgtccctcttcttcactgctgtatctccctgcctagcacagtgccaggtaccacactatgctctgtaggtcagtgattctccggagctctgtaggtcagtcattctcaaagtgttgtccaggaaccccctggggtccccagacccctctaagggcaggcataagcagatctgagaatccagctgcctccaattagcccagacattaaagagattgcaaaaaatgcaaaacaatgccacttctcattaacattttcttggaaaatagagttacttttcataaaaatatctcatttgtgttaacatgcaatgagtttatttatttatttttattttttgagatgaagtttcactcttgtcacccaggctggaatgcaatggtgtgatctcggctcactgcaacctccgcctcctgggttcaagtgattctcctgcctcagcctcctgaatagctgggattacaggcgtgtcccaccatgcctggctaatttttttttctttttctttttcttttttgagacggagtctcgccctgttgcccaggctggaatgcagtggcgcgatcttggctcactgcaaactctgcctcctgggttcatgccttctcctgcctcagcctcctgagtagctgggactacaggtacccgccaccacgcctggctaatttttttgtatttttagtagaaacagggtttcatgatattggctaggctggtcttgaactcctgacctcaggtgatctgcctgctttggcctcccaaagtgctgggattacagtcatgagccactgcacctggccttgttattgttatttttaaatgaatttataagtaaatgtttcaaaatttctgtttttgtttctaccaatagatataatgcatatacacaatttttttttaagaatcctcaaccaatcttaagaacgtaaaggggtcctgagaccaaaagattaagaatcactgccgtcgaggttttaagcttggctaggacacagtctgtacttactgaagtaacccacagtatgacagtaataagacactttatgaagaacatattttcagtagctaagtgtcatagaaaaggaagcttgttagccatttcctcaagttgacaacagagagtccttaggaaaataattttttaaagccaatattgagccttccaagactgcacatggtgatatgttaaatttggaatttatgcaacttaaaaaactgagagtcgggggttggcatttttgtgcatcctaactgacgagtgctgccccagggctctctaacactgcacacagtctactaaagaagcaggctgcccatcatgacccccacccatcagctacacagcacacatctgcttctagatgaaccttcttgcaagtggcctgtcttatggcaaaatcaaggggcaggcctgtaaagcggaccaggaaatgagcagcaactgcataccaccaacctgttgccaagctaactgtgcttttctggatcagaggcagcttgagacactggtccctggggctgagggactgcagagcccgggcacagactccctgcctatctcccagtgtgtccatcttggtacacctggtgcatctctggattggcaagtggcactccccaattaatgttaagggccacttgttttaaatataaccagattattttaatttttaaatgtgtatcccatacttggacactgaaaggtcctccctgtttacctgcttgctggggtctgtgcttgggtgtctcattttattataaaacagagtctcaaaggcatttaatactaagatcaagtggctgggcatccatcatgtgcagagcaggagcctgatggtggtgaaggctcattctgcatgtggttgactctaggaactactttaacagaggggaagaaatacactgggagaaaggagcaggagattcgtcagggctgggggaatactggctccatgagggcagagacttttttctattttttctctttttcagagcctgtaagtgtccacatatcatgcacatgcagtgcgtatttgttgcatgagctcctggtatgcaggtgccaaatgtcatgctaagtgtgtcgactggatgacagaagaaggaaggagggattaaaggaactggtgtgcactggcctgagccttgaagaatggggtgtactgggtaaatcaaaatggtggggagcatttccagatggagaaactgcaaggaaaagcatagaagtggggccacccctcgtgagctggggagggcccagggtatgtgtgctggttggggggaagctgaaactgaggaaattcccattggatccatagcctggttctggtttccacaggcctgggatgccccgtccagagtttgactttcagtctgcacgtaatccaggctttgtattcccacttcccgtatcccctcactcctttttcacacaccctttttatctatgatgctactggggtcatgggttaagaagtcctgtcgtctaagcagcaagggtgcatcaaagcaggattttctccattgattccaaggtgtgattcagaaatggtaaaaactccgaacactaggatgagcactggggatgggttcatgttttttttttatgaaataattcagaacttattaagaattcccttggcaaaccaaattaaatattaaacaactatttgttaatatgttactattggattctatcttagaaaagtgtaattatgtgtaactgaactttttgttttcttgtggttgaaccctgaattaccatgccttctggtttccgtgtttttcctggggaataggtcatatttcttacttccaaagcccagaaataaaagcctcacacatccatccgtagtcccaaaggcttttctgcctagtacccagagagtaacagcagtgcttcaaactatttgtggacaagaagtcctaaaacatcagacacactgtggaaagcaatttcatttcattaatacaattcataattaactgcatttattttattgtctaaattccaactgctaacctatcatatcgacgaattctttgaagttgcctttattctacaggatatgttcatttttagataatgctatttttcatatactttaagttctggggtacatgtgcagaacatgcaggtttgttacatagttatatacgtgccatggtagtttgctgcacccatcaacccatcatctacattaggtatttctcctaatgctatccctcacctaccctcctaccccccgagaggccctggtgtgtgatgttcccctccttgtgtccatgtattctcttgatcatctcccacttattagtgagaacatgtggtgtttggttttctgttcctgtgttagtttgctgagaatgatggtttccagcatcatccatgtccctgcaaaggacatgaactcatccttttttatggctgcatggtattccatggtgtatatgtgccacattttctttatccagtctattgttgatgagcatttgagttggttctgggttcatgttttaaaatctcaatttgctccctagtcctaggaatgatcttctccacctccaaggaatgcaagccccagtgcaacatggattcttcctctgtaagaggctagactccaaataatttgtcctgtttttgcctgtgggatgttacaagtgtaccctgctgtctgtaattgtgtttctgaagtgttctatgtaagtaggtttttgttagttgaattgtactttaaatgtgccaatcaagttccccatgaaaagagatgggcacagagactttttgaaaaattaagcatcccaagagaaaagccgatctgaaaagactacatattatatgattccaattatatgacattctggaaaaggcaagactacagagatactgaaagatcagtgtttgccaaagattagagggagggaggggtgaacaggtggagcactgagggtttttagggcagtgaaactattccgtataatcctataatgttggatacatgtaaatatacatttgtccaaacccacagaatgtccagcaccacaaatgaacgctaatgtaaactacaggcactgggtgataatgacctgtcaatataggttcatcaactgtagcaaatgcactccgatggggaatgttgataatgtgggcaaggctacgcaagtgtaggggcagcaggtgtatggaaatcactctatcttcctctcgggtttgctgcgtactaaaattgctctgagaaataaagtctattttttaaaaaatgaagtattccaattaatttataagttttgccacacgtgcaatgacggccctaaccactttactttggttctccgatactgaatatgtcactgtgaatatctcatcctccttgatcccatccccatcaaaactagagattgaaataaggagatgagatggccctccctgaccgccttgtgcctttcagaggaggtgcctgggctggaatggggaggagctaaggactcctgtgggattctgatgctgggtgtgaaactgtctgcagttagcacggtgttggagagatgagtgctagactttgtatttctggggactagtgataaatgctcattattatttatataattttaaagctacgtttaaatttgtccccagtactagagactttaatgttatattgaaataatacataataggctgcaaatagttatattcttgtcttgttgttgtccatgtatcagcattcttgtatgaatgaaactagaaccaagaagaaaatccatcactacaataatggtccatacattaaaacagtttaggctgtctgatggtctggggtgtgtgtgtgtgtgtgtgtgtgtgtgtgtgtgatatagatatgtatgatatatatgatgtatatatgatttatatatatataaatcatctcatcttgctcaaaacaatatcactcttatttaggtaggcacactggaatatgattttaattaattgaaaagtacagtttgtttcacatttgcaggagtggtttaattcctacacagtgtactaagatggcctctcgtgggctcatgatcctggaagatatactcccaaagtgagggggggtctatgttggaagcaaaaataaaaggaatttaaagaatgacaggtctgggaaattattcttatggatggtcagttcttcatatgataaaatagttatgacaaaccaaacaggcacagtctcatgtatgcactgatttgcatgaaccaactttacagataattgattcagttggttggaactacagtttcttccaaatgtggacaacttacaacagggtgggagccccaaactgtgaagtcatgtgaggtcatatacaaactgaaaaacagggtttctctactggaatgataatcctaccatgttacacttttccccaaaatgaaatccaacatctttcacctggcgtaagaagcccaacatgttctggcccctagaaacccttacatcctgcaaagagggactagagcttgttactcttattagctactcttaaagtcacagaggtagttaatttggcaaggagtggctacaaattcaagacatgtttggatgtgctgagaatcagaatccaatctcggccctcaagtcatgggttaaagacttggttttttatctatatgaggtcctaccttgtagttcaagcagaaacatccaacaaatgaaagcagaaacaacatttgacagctcaaattcaaaagcaagaggcttgtcaatgcaaaagtcttgtgctgcaaatgtttcaagggaagtatccatactctgaagtgtgcaattgaaagaatgacctgatattcttgcactgttgcctcaaacaaacctccctcctcctagctagctccggatcttttatgcatcatatagtacatcttcccaaaaaagcaggtggaaaccaaagtgtgcaaaaacacacattttccaagaacaaatgcattatactagcaagttatgtgtggtggggctaggtgcttctgcgggtgtggaggaggaggagagaaagaagggtcaggaggaagtgtgttgggtacagagacatggaaataagaaacaggaaccctgaaagacacacccgcggaggttctgtaactgtacatgtgctcttgttaaatcgccagtttcagaggactcagatctgaggccatatagaaatctattaatttgcatcttgactttggggcttccagtaacagtaagtatttgtatttcaggatccactcagcagaaaggccatacatattcaagtcacataataaattggtgaattccaagtgaattgtgaataccaaaaaagaaaactgattatgtgactttctggaatatgatgtagaaattgacctaacaaaatgtatatgcacacttacggcatgtgtgcatgagggtgtcatttatgtacacaggtcatgtgcacatccaactcatggccatgcatgctgtagcctgttacccattctgggagatatgtaagcctttgtctttctccctccagcttcctgccttcttaaaacatttcactggtcatcaaccaatgattgaagctgggtgcagaaaaggagaaaaggtgaaaactcctcttagtccacaaggtgacgtgttagtgcttcaagtgaaagggctgtggtggagagccagagaaagcccttaggtggaatgagactgtggttcctataggtcggcaccttcctccccacccggcaggtcagctcatcaattgcacttatctcccagctgccacagcctgtctcactcctttctctctcctgttgggctgctaccaggcctggtaaactattccgtagctctgtgcaatagaaaatagatatgtatttctctgaatatagagagggaaattggagttcacatggaatgcatactgtaaacttatttgttttctgaaagcaaaaattaaacttgaaaggagcaaagcttttcaaatttcccatagtgctggcctcaaatcctaaagatttttttccttgacaagaatcatgggatgaattggaagatctggatgctccattcaccacagttgatgatgctaaaacccatgtgacagcagaggaaagaattgaacattctaaagtcccctctggcaactggaatgccaggggagccttcaccatatacctcatcaagccaccccaacaaacctgccatgtcggtgaaaagaccatgctcactatgaaaatgtggcttctgccgggtgcggtggctcacgcctgtaatcccagcactttgggaggccgaggcaggcggatcacgaggtcaggagatcgagactatcttggctaacacggtgaaaccctgtctccactaaaaatacaaaaaattagccgggcgtggtggtgggcgcctgtagtcccagctactagggaggctgaggtaggagaatagcgtgaacccgggaggcggagcttgcagtgaaccaagatcgcgccactgcactccagcctgggagacagccagactctgtctcaaaaaaaaaaaaaaaaaaagaaaaaaaaaaaagaaaatgtggcttcaagaccagaactctagccctttgtccaaaaaaaaaccatagcccccgagacccctgatggccttgacatgccactgggggtccccttatctatttacattatagaagggcttctaagaagaatggtttcagtcagagaatccaagcaacttatgctaaagtccagcctcatcctcagaactctgggcatgcttgtttttaatgccatgtctatccatctgtgactcattaacgcacttagcaaacactgagtgactgactagtctatctctccccgtgataaaatttaaacgcctcttacaagacatgagtagtctacctacctgttacttgtatgccattacctgaaaaattcccatctgtttggatgcaaacttcacagaaactctgccacaaatgctcacgaacaccatcacatgggctgggctctagtgctttggaatatcctactttcttagaaaaatcgatgagtacatataaatataattagctgcaccttgattcctgcggaatcattgtattaactgctttgggctattctccttctttcctttcaggcaatattaatttgtaacaaacacattttatgatataataaattatctttcattttttactatcaaatacatggagaagtaaaaaaacaaaaaacccagaacttctaggcagctcttaaacaagtcttgctgttacttggaaaagtaacaaattcacaggtttattgtctatgttaataaagctgtgttggagtagtcattataaccttttacattccctcctgtttacagctcacagaatatgtttacacatgtgatctcattcagttgtaacatgatctgcataaattatgggtattaacacttgccatatttattacaacgatttccccagcaatttgtcttcttaattgtataatctatattgcaaacagatgtctgcagtttgtatatgcagctatgtactcctatggtttatgcatctacctcaggccattaaactgtaagctcctggagggcagggatgtatctgattcatttctgtatctccggaacccactgcacagctgctgaatggatacacatctagttacttaacctctgtgtccttcagtttcctcatctgtgaaatggctataatgattgcaggaacctgtcttctctgtcccaattgtattaagcaaaacacttaatacaatgtctagcatataataagcactctatgagtgttttctattattattattattattattattgttataattatctggagttaattgaattaaagttcaaaaagatgacctaactcatttgggggaaggtgatgaataaacggcagaaagaaaggaatatcagggatcttatatgctgatcctagctttgtctaatctgccaagctaagtcgtaagatttttctcttttcaaaatacttctgttaagctagtaaaaattatttacttgtaaagattccatgtgctgctttttctgtcataattgcatttaccttaccaaatacatattgaccatctacacagtggatagcagaggggccacagaaatgagtaaagtctagttcactctgcactggtatctcttttcttccatatttacattttataattacatttgtcaaactgcttcacaggcgaagtcctggaccaggaaccaaataaaattgacccagctttccgaccatggaaaactaaaagtataatcaactttggcaccattaaattctgtttcatttattttttccaagagtctattaacattgtcatacagaagtagaagatttaattgagtgtgtgcattttgagttgaaagcagatactaacaagaaaagctaacctggaagacatcttgtaaactgtttcatcagactggaccaggagccaggggagggtcgaggtgactcagggctgttggcaaagctgcagaaattgccactgggtttctctgtcctctaggcaacctaggctgcattggctctctggcctattattcattacggtttagttcaccacagaggttgccagtgagcagtgcataagattagagattttgtaaaaacatgttaatttgtatgaagacgaaaattggactatggagtttagtgataaaaatagataaacagttctgtcatttgatttaaatattaaaataagacaagacaaagcttttaaggaaatgaccacttcttggttctcaactagaggcaatgcctcttctgtcctgagcagatgggtgtttgggaatacgtggggtgacttgggttgctgtgataatgcaggggttctctggcaatcagagggagagggaggggcaccttcaaactgtggtccagatctacacaatcaggaaaggctgttcacctaaaattcaaccttctgttgagaagagcaacacttacggagctcatcaaagaacgacaaaccactggaacagttcttgagaccaaagtctcattcactctgggacatatccagttacataaatcatttatgttttatcccgtctctactttcccaagaaaccctgccacacattcatagtgaatatcaaacctaattaaagatcctaagcagctgagaaaattactcaatgaccaaactataattagtcttctacaagggagaaaatgtattcaaatcattgcttaattttgtttcatttcctcttacctgcacttgaccattaagatcaaaagtctgagaatttgtggccaaaaaaaatgaacatgagtcaaagtcacatctatttgttaataatggaaagtaattccttttctaattacacgtgaaaatactagtatccaacaaacctatttgtggaaaatacggtttagattgggaaggttaattactttcaggtttttcaatgtccaaaacacacctcagaactaacaggctcagacaagatctttatgagatcactggatcctccctccaaaagcttccccctcccctgttgatctctattccatatgctgcttcatttgatcgtatagcgtgtatgatgagcctgaatgcgggcatttgttgatttgagtattacctgaaacaaaagatacaccagaatgtaaaacccaggagggcagagactgttttcccagaacctagaacaactcctggcacataccagatgtaaaatcattgtagaaagaaagaaagaaagaatgaaagaaaggaaggaaggaaggaaggcatgaaacggtgcactattattgtatgccaccttaagtcactcatagaaaatactgcatgccagcactctatgcaatgggtgttacactagccattatgtaaagtcaatgacgggattatacgctgggcactttataatttaataaacacccttcaattaccgtctcatttgctcctccatgccactccacatagtatacgggacatattttaggatcaccagtttagagataaagacagaggttgtgtccccaaagtttgcttgcgagtgtggtatttgtaacttctaaaactctaactctcccctgaaaacacgtcctaagagtggtgaggctcccacgtgaggtggcaatattggttacccccgctgagctcatcacattgcgcaggcctccacagggcagctacactctacgataaggaacatgaagccctgagagtcaggagggagaaaaaagaaaatgaacgtttggaaaagggcattcccaaatcacaggagaaggggaagaaacgtgtctcagctactaagtttctcttttccatgacgctcaaagcagaaaatggctgcacgtgggcaattcgtgcgcttggagctcagacctgcagtcttgtcgtttgtctgccctgtcttggtgcatgctgggcctgacttttttatttttccatttcaaggagccccagcagggcctggaggaaatgagttttgcagcccatctcggcccttgagcttggctcctcggctgacctcggctccccgcctgcagacccggcatgaggcaggcagcaggcactgcggggcagaacttccgggacctgcaagaccagtccgctgccttctgagacgtagttctgaggtgtagcaagttttcattttcacagcataaaaccgtctacaaatacatacttcaaaatgaaatggaggatgcgctcaaaaaaaaaaaaaaaaaaaaggcttagagacacgtcaaaagggcacaggagctcagccaggtcaaataaattcccaaatttgactcacatcacttcagcctcatctggatattacccacactctgcctaggcaggcgaagcttccgtgggatcctctgtctttagtgaattctttcctttatcttgtccagcttttcattgctctttcagaaactgagcccatggttttaaatcttaatatgaccttgcattcaattatatatatacatatatatatatatacaaagctgttttttaaagacaattttaaataagaaaaaaataattattttagataccagagagtggtgaaataataatgattcaaacttaatcctcacttcacgtaggggaaattgactcaaatctgggagcatcaaaaattaagatgcatttacaaatcctaggagaagatatcctttgtaatctcagagaaaataattgagagagggaaaattttttttgaaagacgtggtttggacatattactattttgtgaaatgaagttaaatgtatggtacagatattaaagttcacttaagttttatctatataaagtgtgtgattttggatctaaacaggcataaatatatatatgtgtgtgtgtgtgtatgtgtacatgtttgcgtacgtatgcatgtgtatgtgtacatgtttgcgtatgtatgcatgtgtatgtgtgagcgtatgtgtgtgtaagtgttgtatatgtgtgtatgtgtgtgtatatgtatgtgtgtatataataggaagtaagttggaaaacatgagccaactgacttttttttccttagacagctaaagaagagtggttagaagtttactcacaagtaaatcttttaaggagcgtttacttcccagaaacagcaatgagatcttggaggggcaattcttgtcaactgtgcatcatcaatggagtttaactgtgagaggtaaaacccattgttggtcccgactccaccaacccaaatggtcatatctgaggacttcctgtggttctcccgcccccaccctctccacggcatttactgctcctgtataccctggacttctcgacaggaaatggcaaattcctcagtaggaaagccaagaagtgggaggtcacatggagactggaagttcattgcgtgcagcccctccaggtgacaggcgacaccgcctctgcatgttgagtgcctttgtgacacatgatctccttgtctcatgaccacaggcagcagggtcctgatgagtgccctggagagaactgtcctcccacccctgggtgacacagagtctcagaagccagcagaggtgctgcaccaaaggctcagactttcaccctgcctctcttctcctcaactctttgccctaaaaaacatgtgctttgagggtgtgttgaaaatctcactaagtcaaatgatgcctgtggggcagaaataacccttgctctgaaagggtcaccaaaaagtcatgagactcctacctgtatggaaggtggtgactatatagcccttgtataaacaaacaaatacggtgaaagacttggctccatttttttttttttgtctgttcgttattttttggagaaaacgttgtgataagaagcctttagcctacaaaaatgtctctagattaatgataatttatctcacttttctcagtgaaacagatgaatcaaagaaagtgaagcatcgtagacaatataggaccttcctgataacatctaacatttaataacgtgatcacagcgtggcggctctaaaagacatgcacatgtgaattaatgcatctaacctgcacactagctaccattatgcccattttaaagatgaggaaaactgagactccaaaaattaaataagttgcctagagcatcttgccagttaatgcaccagaattctaagccagctgcctggttccaaagcgcatgcccataaacgcggaacataatgcaccaaatggcctagaactgaaacgactgcaaaaataagtcaacatatgagaaactagagaatatataaagccagccccaccataatcagtggcaagggatgggagatgggaagaagggagaagggaagggaagctaaataatttcagtttttctctgtgcctttaattcctgtcccctgaagatgacacgctcattttagtagcaacccatgaccaagatgcattccccaagcttttcgcacctgacagaaagggactcggtgtccaggactgtgcccgattacaatcaaagcagatggacccttccttagggtagggctgttcttctgacagcctcctctgtgaaactagattataagaggatgtgctgctctcagacaccctctgcctgtccccgccttggggtccttgcctttgccattcccctggtccgcatcactcctccgaggcatttgcaaaccttgttctcaccttttctttgggtctctgtctgacaggccttgcctgatcatgttctctaaactagaggtcccgccccccggccacctggctctatcatgttccctaccttccctcctaaggctcctgacttcctgccacactctgtcttcgttgagctgtgatctatttgtcagtctcccccatctgcatccccctgattgacagcactgagtgagcccagctgtcctgctgctcatgcccctcagcacccatgagcctagtgggtgcccagtaaatccttagtgagtaaatgaatgagtcaatttccacacaccaaatcccaaagggataaaaagacattgcctttctgccatttcttggaagaattttttgagacaaactaaagaaaggaagctacttgttattaaatttttaaaaatctgcctactattttcaggcaaatatgtcatgatgacatctatgaaatctctgaaattaaagagaagcctgacgtttcacaggaattaaatgaagttgctgcatcacaggtgctccctgccacagggctccgtgtggcagcagcaaacagaactcctcgctgcttaggtgtagtccttaggaatgaaaatctgaacgtagtacgttaaaaaaaaaaatcttcaaaagcaaacaaagccctaagtgtcgctgtgtattatcagggcagggtcctcctcagagagaggcgggctgcaatcgcccctacacctttcaccaagtgcctcgcttcaggggtcccattgtctccacgtttaggtttaggagcctggctcttcgtaacaccagcgaaacatgttctcctaaagatgttccctgagatacaacaccactccgcattgtttcaccacataccagcattaatatcccagagtaatccaccctcctcttaacggctgatgacggctccaatggccatgcaaaaatcagttgaaggaaagggaagtcttgtcggaaatgagattagtcttgtaacgagtgttcagccctgataacccatctgggcacagaactgcttaaactggagagcaattaaccttcacccgacaagctctgtccaaccgttataaacattaaagagacagaatccttcccccctccttgtagactaaacaaccagatttgaaattccacgtaaacggcctctttctgcagatgtgcaccaacaacaacgtttagggggaaaaggtgggcaatggctctgttcataactctggtaacttttggccttggtgtgagtgggctgaggttattagcgtaaaaattaactggaggtatttccaataaaatcaccaggtttaggggactggacatagttgctttcatgcagaaacccatgtgtcctataggaacacaacttgatgcttgagagattcttttttcttttctttctttcctttttttttttttttttttttttgagacagagtctcactctgtcgcccaggctggattgcactggtgcgctcatggctcactgcaaccttgacctccccaggctcaggtaatcctcctacctccacctcccaagtagctgggaccgcaggcgaaggccaccatgccccactaatttttctgttttttgtagagacaaggtttcaccatgttggctaggttggtctcgctcaagcgatccacccaccttggcctcccaaaatgttgggatgacaggcgtgagtcactgcgcctggacttcttttttcaacagtagaaatatttgcactgggctagactctcactcactcccaattcctctcttccgacatttgcatgagtgatgctgcttgtggtcacagaagggagattttttttttaatctccgagaagttattggttttcatggggagcaaacctgtgatcttgcctttatcagcatttgccgtaaccagtcgagttaaccaagttgggccatgtgaaataccgagtggttagagaatctaccaggaaacctactgttaaaaataactttcacaacactgaagagaaatagctgaggtcacttaatttatcactcaggcatgagctttctttagcatcagttcatgctgagccattggcttgtttatggacatgatactaacaataaataggtaaagggtaagggccctatgacatagagctggctacaaaccaatgtggggtacacaatatgcctagcatttaaacaagaaaaaaatgtaaagtacatgcagaaagtcatatgagggaaccaaacctctatgttactgacctgttaatgtgactgcaactcagatttttttaaatagaaagaaaaaaggaaaacatatatttagcatgtcctaaacaaatttatctccccaaggttttagtgcaatcttcatgatgacctgagatagctatcaaaatagtccatcctaacattcgatcttatctctcccttgaacccagtttctctttttccagtaggtaagtcataatactccaggcctcagagacgtgtttgcacacaacgaggctgagcctatctcacttataaggatgacatatctcactcatgctggactccagaccggccccaataacagttttggagagtggcatggtagaggatgtgtgttacatgggaagtactactgtaccctgggacaagatatcctggcaacaggtcttgttttcatggtttgcatttacatgcttaactgttccttttcctgcctttgtaagactaagaaaatccttactgtacagagaaggaactgtgaaaatagagcaagtgggactgactctcacattgcagggatatgcaccatctccatttttgcagccaaattagatgcaagcccaggattccactggcctggttctcccaggaacactgggagtttcttggtgtcttagcttgaggtgaggtgaagatgggctatgggcacgtgagctgaccagtttttcatcctgtgtgcattggacgtagacaagggcacacacagacatgacaagaatccatgacctagctcctaatgtaaatcttctttcccaagacaatcttgcagagccctcatggtcagtgataagaggaacttcaatttttatttggaatctgacccatttcataagaatgagtaacacctgaatatttaggtgcagatatcaaagacagaagacaaaaagaaatcatagtgtttgacaataatattagtataggatgccgttttatgagttcagtcttaggactgtgtaggtgcaacgtgaagactttcctgaagacagccacatgaatcatttttcataggatgtaatcaccactgtcatccattagtccaggcttgacacatagaatgggggtgactggctgcctaagtaacaaactccccacgtgtgcttctgacgaactgtgtgggctgccctaagcttttgcatgtctcgacacttaccaagtaaaatgatgagataaggaaaaccacaacatcatactcagtatcttgtgaaactgaaatggttgcagagtaaacactttgccttacagtgattttattttgactattatgctggatttaacaatataatggttaatatccatgctataaagttttattttttcatcaacaaaactaattgcattggcactttcaaaatgttgtttgcacataaatgatttatacttaagtatgagtgtaacaatcttgccatcaggacctggtctgttgggagatatcagtgaatggagcctggctcttccaatgggcaaccgttgtttgttggtgaagctgccacccttgagacctgcctggtctccttcccacctgtagctggctaagtagtgtctccccacaattcacgtccacctggaacctcagaatatgaccttatttagaagtaggatctttgcagatgtaattaatgattaaaatgagatcatagattagggtaggttctaaatccagtgagagcatcctcataagaggctgagcaggacacacagaaacataaagaagaaggtcgtgggatgacaaaagcagagacggaagggatgcatctacagcagtctccccttatccacgggggacacactacaagacccccaggggatgtctgaaacctcagacaggactgaacccaactgccattaactggaacactttctgttccatccacaaatgcaataccttttccatcttaactaagcacttactatccactgtggtcatcagttttgcagtttgaggtgcaacggcaaaacaagcacagatttctttttatttcttcaaacttcaaagacagaagattcattcttactgtacatcttagcaaccacagcatatgatctttttccttgtaagtacagaactttcaccttttcactgaaagaaagcactttacggcttctctttaacatacccggaattgccaggatcagtcctcttgtgccttggggctactactgaataaaagaagggctacctacacataagcactgtgataccgtgacagtcgatcccataaccaagagggctactcggtgactaacaggcaggtagcatctgtagcatggatacggtggacaaaaggggaattcatgtcctgggtggagcagggcaggatggtacaagacttcatcatgctacttagcatggtgaacaatttaagacgtatgattcatttatttctagaaatggccatctaatatcttcagacagcagatgaaactgccagaaaccatggaaagtggaatcgcggataagagaggactactgtccaagccaaggaacacagggcttgcaggcaacccccggagctggaggaggcaccagatgcatccttcctcacagcctccagaagggaccaacccagccaacacctcgattttggatttctggactcccaagctataacagaataaatttctcttgctttaagccactaggttgtaataatttgtcacagctatcctgagaaactggtaacagtacttgtggatgctgtttttaacaaaaattttgccactttagggcactatatggcctttttttttttttttttttttttgccttatagagttaggtcaatttccaaaagtgctggagtttatgccaagaattaagtgactccctggttgcagtggccaaatagcctgaaattttcaaagtaatactaattttgcaaaacttttcatgtaaactcctttgcctgaccatgccctaatttttgtgattaggaaaatctggctcttatcccactggaggaaaagtgtctagttcatattctaatggaaatcatcacttgggaggtgttttgacaaacatctctcagttttgtttaaaaattatgttagaaattaagaaaaataacgaatggaaaacaaaatctaatttttggtatattttcctgctaacatttgtgggcaaattagttaaattatgattgtttcatgcatacttactcctccaacagcatcctagctctcttaggagttccttttaattatcctaaaaacagttaagagtatactgagccaaaatataattaggttgagaaacaatgaactcctaaatgaccaatcaagttttttccaacattttaattctcaaataaaggtcatttccttttatttgactccttaaaaactagattatagttcttctaggagaggaaccaagtcagatttcttttaatcacatacattgccaaatgcatgctttactcagggaaagatttcaatatgcatcatttattcatgcattcattcattcaggaaacagagtagcactttacatgcggacgctgtggaaacaatggtgatatgaattcttaaatgattaaagaaacagtccactaaaaatcttatcaagataatagaatacttcagattttatgaaagattacattttcattggcctatatataatgttttaaccagtaaggctcactaagttaaataatatgctggataatcttaaatttacagaagggttttcagttttactatttggcttagataagctggtagttacttgctaaaattaatctttattataaagcagatcatcttgaaactgaatacaaaaacaaacgtagctattattgaaaatgttatgctatctcatatccattagagatgttatttatataataagtactgtgttgtaatttgcctgattccaatgaatacagaaaccctcagtgtgaatcaatatactagacaccagcagacatatttaaaagattgctacagtttcactgacatttcaaagaggtgactgtagtaacaaaagaagaaaaatgaatagtccctatcatagcacattaatacaacttgtcactagttcatgtccagaaagacttattatataatagattgtcaaagttgaatatttcaatgacccaatgcaaatcctggataaatgctggtaggtgttgctgctcaataaaaatgaaagtggtgtttggttttgctcatcaaggcaagtgtcatgtagcaaaatgcaggctatgggttgcctggaaactgtattcctgcttttaatttacaagtgaaacattcccatccatggcctggaagggaccatcatgtactcggcagcactcattagattctgggcagcccccggtcatctgaccttcccaaacatagggaaaggacgtggatagacattttcccaaaaagacataataatgaacaatgggtatacgacaaggtgcccaatatcactaatcatcaggaaaatgcaaatcaaagacacaatgaggtatcacctcacgcctgttcagatggctatggtcaaaaagacaagaaatagtaagtgttggcgagaatgtgagaaaagggaatccttgcagactgttggtgggaacatggaatgttgcagacactgtggaaaaaagtatggaggttcctaaagaaattaaaaatagacctaccatatgacccagcaatcccttttctgggtactttcccaaagaaatgtaatcactatctcgtaaagatacccgcagtgccatattcattgcagcattactcacaatagccaagatatgaaaggaaccaaagtgtccatcaatggatgaatacataaaataaattgtggtggatatatacaacggaatatcatttagccttttttttttttgagatggaatctcagtctgttgcccaggctggagtgcagtggcatgatctcgactgactgcaacctctgcctcccaggttcaagtgattctcctgtcttagcctcccacatagctaggattacaggcacccacgaccacaccccactaattattaaatttttagtagagacgggctttcaccatgttggccaggctggtctcgaactcctggcctcaagtgatccacctaccgtggcctcacaaagtgttgggattacaagcgtagccaccatgcccggcccatttagctttcaaaaagagattctgccaattgccacattatggatgaatctggaggacgttatgctaagtgaaataagccacacacagaaagacaaatactgcatgatctcacttatatgtaaaatctataacaaacaaacaaacaaagactcaatggggaaatggggagatgtaggtcaaagaatataaagtagcaaatatgcagggtgaacaagtctagagatctaacgtacaccataagggatatgcttaataataccgtgctgtgctgtacttgggatttttgctttaagagtagattttaggtgctcttgccccacaaaaaaagaatgtgtaaccatgtaagatgatggatatgttaatttgccttcactatcagaaccttatcaccatcttcatgtatatcaaaacatcatgttgtacaccttaaatatataaaataaaacttttaaaaaataaatcaaaaagtcatagttcaaaccactcttttggaaaagtatggatttgttaatataagtggtatataacaattgtatatgcatctggggaaaatggactccatctttcatgatataaaaagcaattctcggccaggcatggtggctcacgcctataatcccagcactttgggaggctgaggcaggtggatcacgaggtcaggagattgagaccatcctggctaacacggtgaaaccccgtctctactaaaaatacaaacaaacaaacaaacaaaaaatagccgggcatggtggcacacgtctgtagtcccagctactcgggaggctgaggcaggggaatctcttgaaccccgggagagggtggaggttgcagtgagccaagattgcaccacagcattccagcctgggcgacagagtgagactctgtctcaaaaaaataaaaaatttttaaaaaacagcaattctttgtgattttaatatagggtgccagccacatcactgattcatgcactcactcatgcatttgtcatgcaggaagttatttattcatttatgaaatggacatttactgatagcctgctttttaataggcaccatcagcatgactgaaaggttacatgacaacagccacagaacttaaggcatagaactttaacaacacacgttttgagttactggtcttgacgcctggctaattttttgtattttagtagagatggggtttcactgtgttgcccaggctggtcgtgaactcctgagctcagacaatccacccgcctcaacctcccaaagtgctgcaattacatgtgtgagccaccgcgcccggtcggggttctatagattcttaatcatgattaaccagcaatatgataattcaatagatccctgctcacctcccctaaagaatgtgccactctaagtagttggttcaaaatagcttgactttttaacctctagatccactccagagaacagtggtctctccccattgcacaaacacattcatttatttaacagcatcacccaaagcataagaatgggaggaaacaatgaacgtccttcatttctccaactttaaattatcaaaactactgattttctgggctcacaaaaatgcagttgagttcagctgttgaaagtttggttaacatgtcagttgagccaccaaatggaataacagttgtaactctcttatgttttctctactgtcctcaaaggaatagcatgagaacaaagcaattagcatacattcaggagttgcataatgatgttttggacaatgacagactgcagataggacgagggtaccataagattataatggagctgaaaaatctctatggcctagtgacatacagctgtagtaacactgtagcacaatgcatttctcacatgtttttggtggtgctggtgtacaaacctactgtgttgccagttgtataaagtatagcacatacaattctgtacagtacataatagttgataatgataatagttgactatgttattggtttacatatttactataccatacttttcatcattattttagagtgtactttttctatttccaaaaaaaaaaaaagttaattgtaaaacagcctcaggcaggtccttcaagaaggattccaaaataaggcactgttatcgtaggagatgacagctccacacagattattgtccctgcagaccttccagtggcacagggacaagatgtagagatgaaaaacagtgatattgatgatcctgaccctgtgtagacctacgctaatgtatgtgtttgtgtcttagtttttaataaaaagtttagaaagttaaaaaaaaaatagaacaaagcttattgagtaaggatataaagaatgaaaatatttctgtacaactgaaccacatatttgtgtttcaagctaagtgagtacaaaagagtcaaaaagtttaaaaaattaataagtaaaaaaagttatagtaatctaatatgaatttactattgaagaaatgttttaataaatttagtgtaaatatacagtctttttttttttttttttgagatggagtctcgctgtgtcaccagactagagtgctgtggcgcaatctcagctcactgcaacctccaactccctggttcaagggattctcctccctccgcctcccaagtagctgggattacaggcatgcgccaccatgcccggctaatttttgtatttttagtagagatggggtttcactatgttggccaggatggtctcgatctcctgacctcgtgatccgcccacctcggcctcccaaagtgctgggattacaggcatgagccaccgcgcctggccaatatacagtgtttataagtctacagtagtagatagtgatgtcctaggctttcacattcactaaccactcactgattcacccagatccacagccactttccatcctgcaagctccattcatggtaagtgccttatacaggtgtacaggtgtatcatttttttcccttcttaataataataattattattattttgagatggggtctcgctctgtagcccaggctggagtgcagaggcatgatctcagctcacagcaacctttgcctcccaggttcaagcaattctcctgcctcagcctcctgagtagctgggactacaggtgcgtgccaccatgcctggctaattttttatatttttagtagagacgggatttcactgtgttagccaggatggtctccatctcctgacctcgtgatctgcccgcctcagcctcccaaagtgctgggattacaggtgtgagccaccgcacctggcctctactgcattattactatacctttcccacattttgatacataaaaaccattgtgttaagtgtcacaattgcctacagtattcagcctggtcacatgctgcacaggtttgtagcctaggagcacaggctacacttatagcctgtagcctacgtgtgcagccggctatgccatgtacatttgtgtaagtgctctttgtgatgtttgcacgatgaaatcatctaacaactcatttctcagaactgaccgggcatggtgatgcatgactgtgtagggaaatactttcacccctttagaagaagctataaataaccaggtataaatgcaggattcctttccaaagacaaatactggaaacaaacacaatcaaggaagataattgattacttcaaaaaaacaattgagatatgagagtaaattaaataagaagactgtgactaggataagtaaccaataacagcccataacagctaacattattattattgttgttattattatgagatgaggtattttgccaggttgcccaggctgacctcagatactgaggctcaagagatcctttgctttggcttcccgagaagctgaaactacaggcagctgccagcatgcctggtctgcaatttacatcttttgtacactacagcacgttactgttcaaagcacatacaagtattaagctgcttaatccttgcaacactaccaagaagtaggagttattatcatgactgactctcttctacagatgaggaaacgaggcacagggaagtgaaaggcgtggtgggacagggacctgcggtctggatctgcttcatatagagaaactgggttcttaagaaggaaaatgggccttaatttctaaatcgtaacaagttcagccctcactcctcttttttttttttttttcactatcctggaaaaaaaaaagaagtggatagaaaggtactaataacaatgagtttaatttctcaaattttattattctttaaaaaggatacattggtacaggagtaaagacaaaaaaaatcaaaaaagaatcgagtattcaaagacccttgatggtgtaacatcaattattttaattttgtttttaaaatttttattttctaaactcctataataattgtttttcaaatggggaaaaagaacgaagtttttattactgcctttctttctacaatatattattcaatggagatactgaacctgtatttgctacaggctaaagaaaataaaataaaacaatccctagccaggcaagggagattttcagagaggatgccaacagggtcctatcccatcaggcatccatgacaaatctgtctgctgtctggtcctgtagcatcacccaaatgtggttcaggcagcactggaaacaatacagactcaggagatcagggaagtcattttgcaaagaagcagaagtgtcaggaggtagcacctgtaaggatgaatgctggagctgtctcatggagtttcacagaaaggtaacaagctgcacaatgactgtctaggggcaacagatacataggaggaaagcagtcttcattcaaacaggatactgagattgacatagtgtgtcttccaacaagataagcaaaagtatgtgaagaaatgagtccctaaaggaaaatatctctttgggcaatttcacttcaattcaatttcatgttaaatacaaaatacatatattgaatatgtggataaaatcactagaatatattcgtgcaataacatctacgtgagacatgacagcatctcaccatgtctggcagtctctcggggtcaaatgcaatctctgccccccacctggcagtcatcggcacttatggaataggccaggcagaaggctctgttagatactgccttcttcccttcgcaatgcactgtcccagacttcctggggtgagagaagtgattgtctatgagagctagcttggagtgaatgaaaacagcatttaagaggctcagcattttctgatcgccaaagggggtacccttcaacatgaggtgacccagcaatgattggctgctgagttctttgagtattttagggacctgcaggagatctgggtggagctgtgggtttccgtgtgtacagtgtgtaaacatcaccctttggtgcttcgccagtgcttaaggggctcccaggtgctatttattttgtttagtttattgttcagtgttattgtttgttgacttgatctatttttttttctcctacaaaggggccagtctgcaaggacacatcctgtagatggctaattgatgatgccctattgtttagtgtgtgtgcactgtggttttatttgcttcggttcaaagggcctaaacaatgcattcgttggaatttagtaactgctgtaaaatcagcacagagaacaatctgtgagctgatattttttgtacccaaatctggtaatctctgcttgactaaagaaagcaaaatctaaaatgacctttcaactaaccatagaaaaggccttccattgaatctcaaagagacttatttttctaccaaatataaaaacattcgaattatgcatcattttccatgattcaaaggagacagaggtgcctacggggcatgttactcatagacaagtctattctagtctaatcacgtccccttaaaaatcaccgagtagatgacaccgaggatgagaacgaggtactgtaatcattactttagaaactttatatttttacctgtttcaagacagaattctcctagaaaatctggagcaacaagcttattccccttggagaggagataacgaataatggaccacgcattcggagagaggaagtttccactgggagcccttcctgcatcagtgcgtctctggttgggctggctatctgtgtaggaagtgaacgcaggaagtatctgtctacaaaccctttatcctcaaggtaattgctgtagcagcattttactgtttaccaaagcagtaaacatgtgatctaaaaaaagatgttttccatctccagaagaacaaggctttaaaaaatgtatacatgtgcttattttgtaaccagcttatcaaaattggttacaataggcttgggctttcaacagtgagtccatgaaaacagctcttgggatggacagaggtaccctcacagggatgcacaagaaacaaagaagtggcttccttcactagaatgctatcctagcaacacacattttatgtcttttctcctaagaccggcttaaccgagttcatactgtttggcttacaaagaaggtaaagtcaacaaaactatctatgttaattcaggttggtagaatgagtaattcacaaagtccaataactcataaaagtcacttacatttggccttggacaatattcttatttttacgtgactataaatatgcttccagtttaggagttcacacaagacaaagtgaaaagttagaactcaaaaggagatgtgtagtggctgcttttgctgacttttgcctggcgtaggccaagcctcctggtccgtcttttcctttgtttctttattccagatcaagcttgcaaacctgcaccgtcccagatttcctggggtaagagaagtgattgtctaggagaggcagcttggaatgaataaaaacaggtccaggaaggatccctcagcatttaagaggctcaggaggggtccccctcatcatccttgttgtcttttgtgtttttcaagccgccttccaggtggatagcgattgcaatgagagagaaagagtatggaaggagaataagaagaatagggagacacagaagttaacaacgccctgaatgtctccttccaggacctgctgtgcagtgtccggtgaactcaccagcaagcatttcccagccctgttttaagcaatctccaatgcagatcaggtgctcgtgaataattgggagctcactgtgtctgtcagagttcttactttataatgaagagataaaaacatgttcatcacaggaaaatggacaaattggctaattgaaaacaaaattcaattcacaaactgttgtagaaattgaaaaaaaaaaggtagggggaaatgcttttcatagattccctgattttagtcttagaagaaaaatgtatttggcttgaatgaatagtaaaattaactaactttgattgaggagcttatgtgtgccatatacagttctgggctcttgcgacttggtgaatctcactataaccctgtgaagtaggaactatcactctacccatttcaccgatggaaaagcctatctcctgtgaggctgtggcttgccaaaggtgaaatggccaggaagtagaacagccagggagtgaaccccaaaagccaggtgggagcccatttcccctgcccactgcacgagacccctccccggtttgaagatccgataggggcactgctgttagctccccctgcgtcctggcagcagcacagtcagcagatggtcactgtggagaaggcggagctgaccacctccattttcctataagggagctagggccaggagaggtgcgttcacctggggaagtcctgcagcatcaaactaaagctccgggccaccctctcccagatgggcctctttccacttccccttgccagcagctatatctatgcctcccatccgttgcacggaagataaggccaatcccttttccacagaggctattttaaggatgccacgaagaaatacagagtaccaagtgcctccctgggccaaagataaaagtgggctgtgctctctggattcaaccttcatgtttttgatgctctctggaaggtcagggaaggcacacatatcgtatggatccaaagaggactacgcaatgcaaaaccacatactttttttttctttttaacttggagcaatgtcttgggacatctacctcaaattgagacacaaactaattgtgttgacagattctaaagtgttgtttcaacagtttcttcttcctcaaaggtgagcatcatgtgcacactgtcaaaattaaaaaaaaaaaaaaaaagacccaataaaacccgatgaaacccaaagagcatggagatgagaaactcactgctggctgacgatctgaatgaatggccttggggggaatgtgaatgtggaggtagcagaagggtcctgtcttcagtgcttgattctgtatcaatacttggtaaatttaaaaaacaaaaaaaccagcaagggagattttaaatcatcaaggcagaaggatttaaaaagtggaatgtgttaaatgcaagagtgcgggatctttgcataaagttattatattttcaaaaattcgacaagcattgtttttaccaaacgtgtttaaagtaacagccctgaggttaatgttatgattggattctgatgtggcactttaaaaataaatcattttgcttggccttagcatttcttttcaaaatgtctctgtacttatctgtgtacaacagcagattaccgttcttcccagagtttaattccatgaacaccctgctgaaagacttgttaaggccttatggaaaactctgacctgcgtgttcattattgacgcccaagacgagtgcaaggaagttgatacttgggatgaggaaatttaaatcagcagctgatctggaatctggaagcactgccccttggatctcgccaaatatggaaagaattcttgtcactgagcaaatatagaattcagtgctagagttttacctcttgaattttctagaactttgttttgattagccacctagagtataagaattgctgcctatgggatttttcccagaagagtagataacataaagtaaccagcgataataattttcattatccaattatttcatgtgtctccataacacttaatacatcatgtttctctgcacagtaattcactatgtacagctagggtgaatagcaggaaaaaagagatcagatgataaagagaagggagacagatttgtgtgacttgtataagatacttcgcctctctaatcctttgtccttatctgtaagaaagcagcagtacccaggctgctgtgaggatcacatgagacattatgagagtttagcacaggacttggcacataacaagcagttattaggatgatgttagtttggattatgaattcaagatactacagctacattttttatactttcttaaacatcaatttaagtcaattttaattaacgttattttactaggagaaatgtctctaaaaacataagaattctatttgaagtctacaatgataattacattactctgatatcttaacttcctctttatgatttcaaataattaaaatttaagtttatgttttcaacaagtgcttattgaacctctactctttgccagtcactgttgaggacacagaagaaatggataagatatcactaaaaacagcttctgcgatatcagtgggtatacataaattattcacactcaacaacaaacacaagcaaagctgggagaatgtgctgacaggaaagaaaatgaagagtgggagagtggacagatgggaatcgatgtgaaattttataaaacatgtcttggccaagctcagtaggggaaatatgtggaaagtaagctagaccaaacagagaataaaagtataaataagaaaaaaaatccagaggtcacagtggaccactagccaaaatgggttcacagcaaacaaacaaaaaaatgtaatgaaatactaaaattaaagaagtacaaataaaaatgagattctgttcttatctgtcagaatggcaaagattcaaagagtaaaatattcagagttgttatgggtgtagtgtggaactggtctcatatgtggctagaaaaagggagaactggtataatccttccagagaataatctggtaattattttttaaattggcaaatatttaaatttggcaaagacttaaaaaatatatatacccattggctcaataattcctttctaggcaccaatactaataaaaagtattcaaaaaattaaatagatggtgtactgcaatataatgagtgaaacatcgcaagcagcatcactttatacactaggatattggttataaaatggtaatacatattttagatagaatataatgaaacaaaaattttgcttatcaaaaaatgttagtaacatgggaaaatgcttgtaaaacaatgctaactgagaagagcaggacaggtaggtagatacaaggccaaacagatacacacggtggagagacatatcccaattgttaggaatttgctgtggttggttaggatctgaacaatttatattgactttgtgatgacttttaaacgttttctctaccataagaattttttatgtttataatttatgctaaagaacaagatgtattttttgtaattcaggagtaaagaggagagtggggtattccagggtgctgttcctgccctaaccaggagcacgatgcagtcataggcctctgccctcctccagcagcctcggctcagaacaggacgaagccaaccctctctgaccagcaccacctcgggcgacccctggacgctccacctgcccctgtgtgtggtacctgccctgctacacctttaacaagcacccctgcaagctccctcctccttccttccctgtcctgtggctgcccagacccagatgtaccctgcctgggtgtgggaggccgcacatcagagcagtctatggctgtgggcttcacagctgaagctgggccgtgggaaatgttgagacgagtgagtgcagagcctgaaagacaatacggtagaaaaggttacatccgcgggggggcgtctgatggcatctgccatttattgaggatgggtgcgagacagggtagccattatgatcccattttacaggtgacgaaactgagatcagacaggctagctaccttgcccagggtcacaacaggaaggaagcaaatgcaagtgtgtctgcggccacgtaaggtgagagaagcgctatcaggggtggtctgacagaatccccaggccagggagcagttgtcctctatcctgtggggtcaaaggaggggacaagaaggctctccttgaggtagctccaaagaaaagaccccgccagagcacagtgtgctaccaaacgctggaacagcctggagactgtccctgtctcttctctgaggtttctcatttcagagaaactctcatccgtctggcttccccatggcccttactctgtgattctcttatgtatcagctgttaaaccaataaatccgccaaattgttgggatgcctataatggctttgggtctccactcccacagagggaatcttattctaaagttctaaatgtatcagtcatattttcctgaagacaacagaaatggttgtttcatttacttatttttatgtatgctttttcaagagttgttaacctgtgtttgtgtttaaataaagatctgttttgcaaaacaaaaactttatgagataatcacttataaacgtagataattaagaaatggttcaggctcagcacattgtctgagagcattgcagtcctgcactgtatttcatgggggaagaaaagcccacagatggagccattctcaatcctgctttccagggtcactgagtcagggtgcctggcatgcatgggtgcatgcacacacaggcagagggccagggagaactgtgctgtgtccacagagggcagcctggatcacagagctgaccaagaacggaagcagcaagttgttttaaagtagttgcctgtaaagccacttttcggcaaggacaaacactcagagcatgctctgaaatgacttatgcacagcagggcagcggcattttgcccctggccttccttccattctcccggaatccccctaaagtaacaaggactgacgcaattcgtatttcacttagccaacaggttgatgaaaaatcataaatctgtagctattaaactcattaatcacatccatcaaaattctgtgaggagttaactttcttcatataactcttagtcttaattaagtttccctcacatgtgatagcaaacgttcaagaagtgcaaatgtgcagacgtggcgtatataatgcaagctttatgtctttaaattaataaaattgagtcctatcaggtcgtgtttcaattaccatcaaaccttccaacctctgttaattcaaaaaaaagtaacttctttaggcaagtcatggaaatagcactagggtgccctcaggtctccaccaagccttgttagtaactttccatgtcctgtctgatttttaagatgctttcccctgatgctgctgccggctgctggctctctccacatccttcaatgtcagatctctgtgatgatggaaaatcccccacattccctttttacacattaagtatctttctaggatcagaacttgcaacctggggttcatgttctccttaaaaggtccggggagaggactgtatttctgttgtaattctatgtatttctttttaggcaccagaaagtattattctgagaaaggactgtaggcttcactagacttcccaaattgcagatggcattaaaaaaaaaggaatcaggaaagtctttgggaaattaggctaaaactcctaactgaagcacaatcgagttttcagtgcaacagcaggatccctgcagtctgtagcaaacactgagatgtttgtggggacagtggggccggtgaggttcagcacctctcaatattgtcagatgtcaccaatgcccaagggaagcaccaaaaccaatcagtgaattgtctgcaaaccatcagctttgttgcttccaagtctttactagaactcttaagctgatcttaaaattcacagacacttagagataaatgaacactctcacataagttcccaaaattcctttacttcttccaattgaaacattttgttcccaatttcaagttaccaagggaaaatgatggtaagaatcacaaagactggatacgaatatttagcttttcatagtgtctcatagggtcttacaaatgttaatgcaaaaaaataaaaactccactcaaatgcagaaaaccaacttaaaaaattcagagcatctgatacctaatcgactaattgatttatttactgaaacaacaaaaaaacagagtgcattgagactggaaattgcctctatggggggctgtttcctaattccagtggacagccatcattttccctatgctaacttgggctttgcgctaacgtaattgaaactgtagtcaacagactcaggacctcctttttccactctataaacaaggctgtaaaatcatctcattactttacccaggaaatctaacagaaacatgtcttaaaggaagtcacctataaagagggcctattttaacagaagattaaaaaaaaattcacctgtagtcattctaagggttcacttgggtacatacaataaacacataatgcaatgtaataaaatgttaaatcaagcatagtaccttagacaagtgtaaactattatttccaaaaaagtgttcagaaaatcacaaaatattcaaactttcaaaatagcttcatgtattcataaatgtatacttcaaattaaacagtataacacatttggatgttttgcaaaatgtacctaccttctaaaggatggtctgttatttcaatgtcctttttaatgcactgagttttttgggaaaaaaaaccacataagatcgtacccaagctattcaagatttacacagaatatttgatttaacatgcatatgaataaggatgaaaataagaacaaaaaaataacattttgggtcacaaaatcaagtaatttctattcatgtagctataagtagggcacattaactctcaattttataattcctgtctataggagccatatttcagcagattccaatccttgaagccaaagaaagaaaagtataaggtgaaagttcttggtacacagatttttaatatattattgaacacaccttgagaaataaaagctgaacttctcaaacacagtttctatggtacatatgagtcaaatcttctaatacaaacatttcaaattatgaaaataccaaaccaaagagtatttttgaaaatggcttggcccaattctgggcaaacttccattttcttatgcactttccaacaaactaaaagccttatgaaaacaccaccaaatgcttctcacctccgtgcagcaaaactaaagacatgcaacaaacacaattttcttttccctccactcagcatctgcttttgttgctgatttttcacatttctacaaatgtcacgaaggcatggtggcctttaaaacaactgaacggacccccattcaagactgcatgccccttgacttgtagtcaccattaaattggcttcatttccaggaatcaggccatatttaggattgtacctgtgcagatttacctccacattaatctctacatgctatctactaaaaacttaggcaaggaaatgcatcagaccaaacaccccacagcacagagaaccgaccggccattgctttccaatctccgcaaacctaaccattgctggaagaaatcttactcacagtgcacagacagtaggtattttattgaagataaacatatagtggaacaaaccaaattacccccatttgagttacgtgagcactcagttctcagcgtggatgtcccacaaatcaagtcaacatttgcgtcccattaccagcagccacttgccgagtatctcttcgcttccactgggactgcctggcatccctgatgctaaggagccactgaagagcctccaaatgtctgacattcacaaacgcatcttttgctttgacccgacccttcaacctctccgagtctgctgccttttctcagacacacatccaggcaccgttagggatagttagagaatctgaaaattcagaagcgctccgaaaagcctttccaaaagtaatccacagcactcaacagtgaatttagaaaccccaatttttttctgagtttgaagtttttaagccttgcggatggttggagtaggaaaaaggaaatttactaggcagtgcaaaggaaatcttgttgtcctctattgtggcagtgggggtgttgcccaaccctaacttatctgccttgataaaggaaaccaaagaaaagagtaacaagaacaagattttgtcaaattaaaaggaaccctttccttaccttaatagtgctggccataatgcgatcaagtttattgatcgttaataaatgttaataataattattgcttctctctgaccagaaagtagttttgatgaggttgtttagagcggatgagattgtgctaagtctgggaaatgaa

SEQ ID NO: 1020 - DNA, 118480 bp, Homo sapiens; identical to SEQ ID NO: 1019
